US008211428B2

(12) United States Patent
Madison

(10) Patent No.: US 8,211,428 B2
(45) Date of Patent: Jul. 3, 2012

(54) PROTEASE SCREENING METHODS AND PROTEASES IDENTIFIED THEREBY

(75) Inventor: Edwin L. Madison, San Francisco, CA (US)

(73) Assignees: Torrey Pines Institute for Molecular Studies, San Diego, CA (US); Catalyst Biosciences, Inc., South San Francisco, CA (US)

( * ) Notice: Subject to any disclaimer, the term of this patent is extended or adjusted under 35 U.S.C. 154(b) by 1206 days.

(21) Appl. No.: 11/825,627

(22) Filed: Jul. 5, 2007

(65) Prior Publication Data

US 2009/0123452 A1 May 14, 2009

Related U.S. Application Data

(60) Provisional application No. 60/818,804, filed on Jul. 5, 2006, provisional application No. 60/818,910, filed on Jul. 5, 2006.

(51) Int. Cl.
*A61K 38/48* (2006.01)
*C40B 20/04* (2006.01)
*C40B 30/04* (2006.01)
*C07K 14/00* (2006.01)

(52) U.S. Cl. .......... 424/94.64; 424/94.63; 506/4; 506/5; 506/9; 506/18; 435/212; 435/215; 435/243; 435/320.1; 530/350; 536/23.2

(58) Field of Classification Search ............... 424/94.64, 424/94.63; 506/4, 5, 9, 18; 435/212, 215, 435/320.1, 243; 530/350; 536/23.2
See application file for complete search history.

(56) References Cited

U.S. PATENT DOCUMENTS

| | | | |
|---|---|---|---|
| 3,536,809 A | 10/1970 | Appelzweig | 424/435 |
| 3,598,123 A | 8/1971 | Zaffaroni | 128/268 |
| 3,630,200 A | 12/1971 | Higuchi | 128/260 |
| 3,845,770 A | 11/1974 | Theeuwes | 128/260 |
| 3,916,899 A | 11/1975 | Theeuwes | 128/260 |
| 4,008,719 A | 2/1977 | Theeuwes | 424/427 |
| 4,046,722 A | 9/1977 | Rowland | 530/362 |
| 4,331,647 A | 5/1982 | Goldenberg | 424/1.37 |
| 4,348,376 A | 9/1982 | Goldenberg | 424/1.49 |
| 4,361,544 A | 11/1982 | Goldenberg | 424/1.49 |
| 4,444,744 A | 4/1984 | Goldenberg | 424/1.49 |
| 4,460,561 A | 7/1984 | Goldenberg | 424/1.49 |
| 4,468,457 A | 8/1984 | Goldenberg et al. | 435/68.1 |
| 4,624,846 A | 11/1986 | Goldenberg | |
| 4,671,958 A | 6/1987 | Rodwell et al. | 424/1.53 |
| 4,769,027 A | 9/1988 | Baker et al. | 424/493 |
| 4,818,709 A | 4/1989 | Primus et al. | 435/7.23 |
| 4,892,538 A | 1/1990 | Aebischer et al. | 604/891.1 |
| 4,925,648 A | 5/1990 | Hansen et al. | 424/1.53 |
| 4,932,412 A | 6/1990 | Goldenberg | 600/431 |
| 4,952,496 A | 8/1990 | Studier et al. | 435/21.41 |
| 5,033,252 A | 7/1991 | Carter | 53/425 |
| 5,052,558 A | 10/1991 | Carter | 206/439 |
| 5,059,595 A | 10/1991 | Le Grazie | 424/468 |
| 5,073,543 A | 12/1991 | Marshall et al. | 514/21 |
| 5,120,548 A | 6/1992 | McClelland et al. | 424/473 |
| 5,223,409 A | 6/1993 | Ladner et al. | 506/1 |
| 5,283,187 A | 2/1994 | Aebischer et al. | 435/182 |
| 5,304,482 A | 4/1994 | Sambrook et al. | 435/226 |
| 5,323,907 A | 6/1994 | Kalvelage | 206/531 |
| 5,332,567 A | 7/1994 | Goldenberg | 424/1.49 |
| 5,443,953 A | 8/1995 | Hansen et al. | 424/1.49 |
| 5,486,602 A | 1/1996 | Sambrook et al. | 536/23.2 |
| 5,541,297 A | 7/1996 | Hansen et al. | 530/391.7 |
| 5,550,042 A | 8/1996 | Sambrook et al. | 435/212 |
| 5,591,767 A | 1/1997 | Mohr et al. | 514/413 |
| 5,601,825 A | 2/1997 | Hansen et al. | 424/183.1 |
| 5,635,603 A | 6/1997 | Hansen et al. | 530/391.5 |
| 5,637,288 A | 6/1997 | Goldenberg et al. | 424/1.49 |
| 5,639,476 A | 6/1997 | Oshlack et al. | 424/468 |
| 5,658,727 A | 8/1997 | Barbas et al. | 506/9 |
| 5,674,533 A | 10/1997 | Santus et al. | 424/493 |
| 5,677,427 A | 10/1997 | Goldenberg et al. | 530/387.3 |
| 5,686,578 A | 11/1997 | Goldenberg | 530/387.3 |
| 5,698,178 A | 12/1997 | Goldenberg | 424/1.49 |
| 5,728,564 A | 3/1998 | Sambrook et al. | 435/215 |
| 5,733,566 A | 3/1998 | Lewis | 424/426 |
| 5,766,842 A | 6/1998 | Melnick | 435/5 |
| 5,789,208 A | 8/1998 | Sharon | 506/14 |
| 5,789,554 A | 8/1998 | Leung et al. | 435/6 |
| 5,821,047 A | 10/1998 | Garrard et al. | 435/5 |
| 5,849,500 A | 12/1998 | Breitling et al. | 435/7.1 |

(Continued)

FOREIGN PATENT DOCUMENTS

EP 1 633 865 2/1994

(Continued)

OTHER PUBLICATIONS

Dementiev et al., "Canonical inhibitor-like interactions explain reactivity of alpha 1-proteinase inhibitor Pittsburgh and antithrombin with proteinases," J. Biol. Chem. 278:37881-37887 (2003). Harris, J. and C. Craik, "Engineering enzyme specificity," Curr. Opin. Chem. Biol. 2(1):127-132 (1998).
Kuo et al., "Comparative evaluation of the antitumor activity of antiangiogenic proteins delivered by gene transfer," Proc. Natl. Acad. Sci. U.S.A. 98(8):4605-4610 (2001).
Mignatti, P. and D. Rivkin, "Biology and biochemistry of proteinases in tumor invasion," Physiol. Rev. 73:161-195 (1993).
Ye, S. and Y. Goldsmith, "Serpin and other covalent protease inhibitors," Curr. Opin. Struct. Biol. 11:740-745 (2001).
Boersrna et al., "Selection strategies for improved biocatalysts," FEBS Journal 274:2181-2195 (2007).

(Continued)

*Primary Examiner* — Chih-Min Kam
(74) *Attorney, Agent, or Firm* — McKenna Long & Aldridge LLP; Stephanie Seidman; Karen G. Potter

(57) ABSTRACT

Methods for identifying modified proteases with modified substrate specificity or other properties are provided. The methods screen candidate and modified proteases by contacting them with a substrate, such as a serpin, an alpha macroglobulins or a p35 family protein or modified serpins and modified p35 family members or modified alpha macroglobulins, that, upon cleavage of the substrate, traps the protease by forming a stable complex. Also provided are modified proteases.

59 Claims, 1 Drawing Sheet

U.S. PATENT DOCUMENTS

| | | | |
|---|---|---|---|
| 5,866,413 A | 2/1999 | Sambrook et al. | 435/320.1 |
| 5,922,302 A | 7/1999 | Goldenberg et al. | 424/1.41 |
| 6,077,697 A | 6/2000 | Hadlaczky et al. | 435/6 |
| 6,168,919 B1 | 1/2001 | Short | 435/69 |
| 6,187,287 B1 | 2/2001 | Leung et al. | 424/9.1 |
| 6,271,012 B1 | 8/2001 | Van Eekelen et al. | 435/221 |
| 6,319,500 B1 | 11/2001 | Goldenberg | 424/178.1 |
| 6,383,775 B1 | 5/2002 | Duff et al. | 435/69.1 |
| 6,423,538 B1 | 7/2002 | Wittrup et al. | 435/320.1 |
| 6,867,010 B1 | 3/2005 | Pedersen et al. | 435/7.4 |
| 7,030,231 B1 | 4/2006 | Craik et al. | 536/23.1 |
| 7,227,009 B2 | 6/2007 | Craik et al. | 536/23.1 |
| 7,335,504 B2 | 2/2008 | Haupts et al. | 435/226 |
| 7,439,226 B2 | 10/2008 | Roller et al. | 514/10 |
| 7,939,304 B2 | 5/2011 | Ruggles | 435/183 |
| 2002/0022243 A1 | 2/2002 | Harris et al. | 435/23 |
| 2002/0031801 A1 | 3/2002 | Kapeller-Libermann | 435/69.1 |
| 2002/0192673 A1 | 12/2002 | Labaer et al. | 435/6 |
| 2002/0192754 A1 | 12/2002 | Jenne et al. | 435/69.1 |
| 2003/0050251 A1 | 3/2003 | Semple et al. | 514/19 |
| 2003/0119168 A1 | 6/2003 | Madison et al. | 435/226 |
| 2003/0134298 A1 | 7/2003 | Madison et al. | 435/6 |
| 2003/0134794 A1 | 7/2003 | Madison et al. | 514/12 |
| 2003/0143219 A1 | 7/2003 | Madison et al. | 424/94.67 |
| 2004/0001801 A1 | 1/2004 | Madison et al. | 424/85.1 |
| 2004/0072276 A1 | 4/2004 | Koltermann et al. | 435/23 |
| 2004/0146938 A1 | 7/2004 | Nguyen et al. | 435/7.1 |
| 2004/0235054 A1 | 11/2004 | Lam et al. | 435/7.1 |
| 2005/0002897 A1 | 1/2005 | Haupts et al. | 424/85.1 |
| 2005/0059126 A1 | 3/2005 | Haupts et al. | 435/183 |
| 2005/0112579 A1 | 5/2005 | Madison et al. | 435/6 |
| 2005/0130883 A1 | 6/2005 | Roller et al. | 514/10 |
| 2005/0158297 A1 | 7/2005 | Jensenius et al. | 424/94.6 |
| 2005/0175581 A1 | 8/2005 | Haupts et al. | 424/85.1 |
| 2006/0002916 A1 | 1/2006 | Ruggles et al. | 424/94.63 |
| 2006/0024289 A1 | 2/2006 | Ruggles et al. | 424/94.64 |
| 2006/0029590 A1 | 2/2006 | Thanos et al. | 424/94.63 |
| 2006/0069035 A1 | 3/2006 | Higazi | 514/17 |
| 2006/0099625 A1 | 5/2006 | Craik et al. | 435/6 |
| 2006/0104979 A1 | 5/2006 | Craik et al. | 424/146.1 |
| 2006/0115874 A1 | 6/2006 | Garrard et al. | 435/69.1 |
| 2006/0269538 A1 | 11/2006 | Koltermann et al. | 424/94.63 |
| 2007/0093443 A1 | 4/2007 | Madison et al. | 514/44 |
| 2008/0051559 A1 | 2/2008 | Craik et al. | 530/350 |
| 2008/0102415 A1 | 5/2008 | Oyhenart et al. | 424/457 |
| 2008/0160558 A1 | 7/2008 | Koltermann et al. | 435/23 |
| 2009/0047210 A1 | 2/2009 | Ruggles et al. | 424/1.11 |
| 2009/0098103 A1 | 4/2009 | Madison et al. | 424/94.64 |
| 2009/0136477 A1 | 5/2009 | Nguyen et al. | 424/94.64 |
| 2009/0155248 A1 | 6/2009 | Craik et al. | 424/133.1 |
| 2009/0175873 A1 | 7/2009 | Liu | 424/139.1 |
| 2009/0208440 A1 | 8/2009 | Haupts et al. | 424/70.14 |
| 2009/0208474 A1 | 8/2009 | Haupts et al. | 424/94.3 |
| 2009/0291890 A1 | 11/2009 | Madison et al. | 514/12 |
| 2011/0177581 A1 | 7/2011 | Ruggles et al. | 435/212 |

FOREIGN PATENT DOCUMENTS

| | | |
|---|---|---|
| EP | 1361284 | 11/2003 |
| EP | 1726643 | 11/2006 |
| EP | 1 504 117 | 7/2007 |
| JP | A-5-503211 | 6/1993 |
| WO | 90/02809 | 3/1990 |
| WO | WO 91/05048 | 4/1991 |
| WO | 91/17271 | 11/1991 |
| WO | 92/01047 | 1/1992 |
| WO | 92/06203 | 4/1992 |
| WO | 92/09690 | 6/1992 |
| WO | 92/15679 | 9/1992 |
| WO | 92/18619 | 10/1992 |
| WO | 92/20791 | 11/1992 |
| WO | 93/01288 | 1/1993 |
| WO | 93/25221 | 12/1993 |
| WO | 94/17784 | 8/1994 |
| WO | 99/51773 | 10/1999 |
| WO | 00/53232 | 9/2000 |
| WO | 00/71694 | 11/2000 |
| WO | WO 00/68247 | 11/2000 |
| WO | 01/05950 | 1/2001 |
| WO | 01/18215 | 3/2001 |
| WO | WO 01/18216 | 3/2001 |
| WO | 01/32711 | 5/2001 |
| WO | 01/40803 | 6/2001 |
| WO | WO 01/57194 | 8/2001 |
| WO | WO 01/97794 | 12/2001 |
| WO | 02/08392 | 1/2002 |
| WO | WO 02/20475 | 3/2002 |
| WO | WO 02/072786 | 9/2002 |
| WO | WO 02/077263 | 10/2002 |
| WO | WO 02/077267 | 10/2002 |
| WO | WO 02/092841 | 11/2002 |
| WO | WO 02/095007 | 11/2002 |
| WO | 02/097059 | 12/2002 |
| WO | WO 03/004681 | 1/2003 |
| WO | 03/029456 | 4/2003 |
| WO | WO 03/031585 | 4/2003 |
| WO | WO 03/044179 | 5/2003 |
| WO | WO 03/095670 | 11/2003 |
| WO | WO 03/104394 | 12/2003 |
| WO | WO 2004/005471 | 1/2004 |
| WO | WO 2004/113521 | 12/2004 |
| WO | WO 2004/113522 | 12/2004 |
| WO | WO 2005/123119 | 12/2005 |
| WO | WO 2006/067198 | 6/2006 |
| WO | 2006/125827 | 11/2006 |
| WO | WO 2006/125827 | 11/2006 |

OTHER PUBLICATIONS

Light et al., "Random mutagenesis of staphylococcal nuclease and phage display selection," Bioorgan. Med. Chem. 3:955-967 (1995).

McGrath et al., "Ecotin: lessons on survival in a protease-filled world," Protein Science 4:141-148 (1995).

Widersten et al., "Glutathione transferases with novel active sites isolated by phage display from a library of random mutants," J. Mol. Biol. 250:115-122 (1995).

Barbour et al., "Functional diversification during evolution of the murine alpha(1)-proteinase inhibitor family: role of the hypervariable reactive center loop," Molecular Biology and Evolution, 19:718-727 (2002).

Caputo et al., "Conversion of the substrate specificity of mouse proteinase granzyme B," Nature Structural Biology, 1(6):364-367 (1994).

Dang et al., "Rational engineering of activity and specificity in a serine protease," Nature Biotechnology, 15(2):146-149 (1997).

Guinto et al., "Unexpected crucial role of residue 225 in serine proteases," Proc Natl Acad Sci U S A. 96:1852-1857 (1999).

Hegyi et al., "Mutational analysis of the active centre of coronavirus 3C-like proteases," J. Gen. Virology 83:581-593 (2002).

Jallat et al., "Altered specificities of genetically engineered alpha1 antitrypsin variants," Protein Engineering, 1(1):29-35 (1986).

Ogata et al. "Comparison of thrombolytic therapies with mutant tPA (lanoteplase/SUN9216) and recombinant tPA (alteplase) for acute myocardial infarction," Japanese Circulation Jornal 62(11):801-806 (1998).

Rotonda et al., "The three-dimensional structure of human granzyme B compared to caspase-3, key mediators of cell death with cleavage specificity for aspartic acid in PI.," Chemistry & Biology, 8(4):357-368 (2001).

Sidhu et al., "Phage display for selection of novel binding peptides," Methods in Enzymology, 328:333-363 (2000).

Silverman et al., "The serpins are an expanding superfamily of structurally similar but functionally diverse proteins," J. Biol. Chem. 276:33293-33296 (2001).

Takagi et al., "Construction of novel subtilisin E with high specificity, activity and productivity through multiple amino acid substitutions," Prot. Eng., 10:985-989 (1997).

Tong et al., "Identification of plasma proteases inhibited by Manduca sexta serpin-4 and serpin-5 and their association with components of the prophenol oxidase activation pathway," J. Biol. Chem., 280:14932-14942 (2005).

Venekei et al., "A rapid and effective procedure for screening protease mutants," Protein Engineering, 9:85-93 (1996).

Oberst et al. "The activation of matriptase requires its noncatalytic domains, serine protease domain, and its cognate inhibitor." J Biol Chem 278(29):26773-26779 (2003).

Bornscheuer et al., "Improved biocatalysts by directed evolution and rational protein design," Curr Opin in Chem Biol 5(2):137-143 (2001).

Peimbert and Segovia et al., "Evolutionary engineering of a β-lactamase activity on a D-Ala D-Ala transpeptide fold," Protein Engineering 16:27-35 (2003).

Bergstrom et al., "Binding of nonphysiological protein and peptide substrates to proteases: differences between urokinase-type plasminogen activator and trypsin and contributions to the evolution of regulated proteolysis" Biochemistry 42(18):5395-402 (2003).

Bertschinger et al. "Selections for enzymatic catalysts" in Phage display in Biotech. and Drug Discovery (Sidhu S, ed), pp. 461-491 (2005).

Cameron et al., "Comparison of the substrate-binding pockets of the Rous sarcoma virus and human immunodeficiency virus type 1 proteases," J Biol Chem. 268:11711-11720 (1993).

Cameron et al., "Mutational analysis of the substrate binding pockets of the Rous sarcoma virus and human immunodeficiency virus-1 proteases," J Biol Chem. 269: 11170-11177 (1994).

Coombs et al., "Directing sequence-specific proteolysis to new targets," J Biol Chem 273:4323-4328 (1998).

Coombs et al., "Distinct mechanisms contribute to stringent substrate specificity of tissue-type plasminogen activator," J. Biol. Chem. 271:4461-4467 (1996).

Coombs et al., "Revisiting catalysis by chymotrypsin family serine proteases using peptide substrates and inhibitors with unnatural main chains," J Biol Chem 274(34):24074-24079 (1999).

Demartis et al., "A strategy for the isolation of catalytic activities from repertoires of enzymes displayed on phage," J Mol. Biol. 286:617-633 (1999).

Ding et al., "Origins of the specificity of tissue-type plasminogen activator," PNAS 92:7627-7631 (1995).

Droge et al. "Directed evolution of Bacillus subtilis Lipase A by use of enantiomeric phosphonate inhibitors: crystal structures and phage display selection," ChemBioChem, 7:149-157 (2006).

Evnin et al., "Substrate specificity of trypsin investigated by using a genetic selection," Proc. Natl. Acad. Sci. USA 87:6659-6663 (1990).

Fernandez-Gacio et al. "Phage display as a tool for the directed evolution of enzymes," Trends in Biotech. 21:408-414 (2003).

Gething et al., "Variants of human tissue-type plasminogen activator that lack specific structural domains of the heavy chain," The EMBO J. 7:2731-2740 (1988).

Gupta et al., "Bacterial alkaline proteases: Molecular approaches and industrial applications," Applied Microbiology and Biotechnology 59:15-32 (2002).

Harris et al. "Definition and redesign of the extended substrate specificity of granzyme," J Biol Chem 273(42):27364-27373 (1998).

Harris et al., "Rapid and general profiling of protease specificity by using combinatorial fluorogenic substrate libraries," Proc Natl Acad Sci U S A 97(14):7754-7759 (2000).

Heinis et al., "Selection of catalytically active biotin ligase and trypsin mutants by phage display," Protein Engineering 14:1043-1052 (2001).

Hervio et al., "Negative selectivity and the evolution of protease cascades: the specificity of plasmin for peptide and protein substrates," Chem Biol. 7(6):443-453 (2000).

Hopfner et al., "Coagulation factor IXa: the relaxed conformation of Tyr99 blocks substrate binding," Structure Fold Des. 7(8):989-996 (1999).

Ke et al., "Distinguishing the specificities of closely related proteases," J. Biol. Chem. 272:16603-16609 (1997).

Ke et al., "Identification of a hydrophobic exosite on tissue type plasminogen activator that modulates specificity for plasminogen," J Biol Chem 272:1811-1816 (1997).

Ke et al., "Optimal subsite occupancy and design of a selective inhibitor of urokinase," J Biol Chem 272:20456-20462 (1997).

Ke et al., "Rapid and efficient site-directed mutagenesis by single-tube 'megaprimer' PCR method," Nucleic Acids Res. 25(16):3371-3372 (1997).

Kirkegaard et al., "Engineering of conformations of plasminogen activator inhibitor-1," Eur J Biochem 263:577-586 (1999).

Lien et al., "Combinatorial strategies for the discovery of novel protease specificities" Comb Chem High Throughput Screen. 2(2):73-90 (1999).

Lorentsen et al., "Substrate turnover and inhibitor binding as selection parameters in directed evolution of blood coagulation factor Xa" Org. Biomol. Chem. 1:1657-1663 (2003).

Madison and Sambrook, "Probing structure-function relationships of tissue-type plasminogen activator by oligonucleotide-mediated site-specific mutagenesis," Methods Enzymol 223:249-271 (1993).

Madison et al., "Amino acid residues that affect interaction of tissue-type plasminogen activator with plasminogen activator inhibitor 1," Proc. Natl. Acad. Sci. USA 87:3530-3533 (1990).

Madison et al., "Converting tissue plasminogen activator to a zymogen: a regulatory triad of Asp-His-Ser," Science 262:419-421 (1993).

Madison et al., "Restoration of serine protease-inhibitor interaction by protein engineering," J Biol. Chem. 265:21423-21426 (1990).

Madison et al., "Serpin-resistant mutants of human tissue-type plasminogen activator," Nature 339:721-724 (1989).

Madison et al., "Substrate specificity of tissue type plasminogen activator. Characterization of the fibrin independent specificity of t-PA for plasminogen," J Biol. Chem. 270:7558-7562 (1995).

Madison, E., "Substrate specificity of tissue type plasminogen activator," Adv Exp Med Biol. 425:109-121 (1997).

Ruggles et al. "Characterization of structural determinants of granzyme B reveals potent mediators of extended substrate specificity" J Biol Chem 279(29):30751-30759 (2004).

Shohet et al., "Inhibitor-resistant tissue-type plasminogen activator: an improved thrombolytic agent in vitro," Thromb Haemost 71:124-128 (1994).

Smith et al., "Protein loop grafting to construct a variant of tissue-type plasminogen activator that binds platelet integrin alpha IIb beta 3" J Biol Chem. 270(51):30486-90 (1995).

Strandberg and Madison "Variants of tissue-type plasminogen activator with substantially enhanced response and selectivity toward fibrin co-factors" J Biol Chem 270:23444-23449 (1995).

Sui et al., "Functional effects of single amino acid substitutions in the region of Phe113 to Asp138 in the plasminogen activator inhibitor 1 molecule," Biochem J 331:409-415 (1998).

Tachias and Madison, "Converting tissue type plasminogen activator into a zymogen. Important role of Lys156," J Biol Chem 272:28-31 (1997).

Tachias and Madison, "Converting tissue-type plasminogen activator into a zymogen," J Biol Chem. 271(46):28749-752 (1996).

Tachias and Madison, "Variants of tissue-type plasminogen activator that display extraordinary resistance to inhibition by the serpin plasminogen activator inhibitor type 1," J Biol Chem 272:14580-14585 (1997).

Tachias et al. "Variants of tissue-type plasminogen activator which display substantially enhanced stimulation by fibrin" J Biol. Chem., 270: 18319-18322 (1995).

Varadarajan et al., "Engineering of protease variants exhibiting high catalytic activity and exquisite substrate selectivity," PNAS 102:6855-6860 (2005).

Waugh et al., "The structure of the pro-apoptotic protease granzyme B reveals the molecular determinants of its specificity," Nat Struct Biol 7(9):762-765 (2000).

Barrett et al., "Evolutionary families of metallopeptidases," Meth. Enzymol. 248:183-228 (1994).

Barrett et al., "Families of aspartic peptidases, and those of unknown catalytic mechanism," Meth. Enzymol. 248:105-120 (1994).

Barrett et al., "Families of cysteine peptidases," Meth. Enzymol 244:461-486 (1994).

Barrett et al., "Families of serine peptidases," Meth. Enzymol. 244:18-61 (1994).

Barrett, A., In: Proteinase Inhibitors, Ed. Barrett, A.J., Et al., Elsevier, Amsterdam, pp. 3-22 (1986).

Bianchi et al. "Inhibiting viral proteases: challenges and opportunities," Biopolymers 66:101-114 (2002).

Fay et al., "Platelets inhibit fibrinolysis in vitro by both plasminogen activator inhibitor-1-dependent and -independent mechanisms," Blood 83:351-356 (1994).
Freidrich et al., "Catalytic domain strucures of MT-SP1/matripase, a matrix degrading transmembrane serine proteinase," J Biol Chem 277(3):2160-2168 (2002).
Fujise et al., "A tissue plasminogen activator/P-selectin fusion protein is an effective thrombolytic agent," Circulation 95(3):715-722 (1997).
Hartley, B., "Enzyme Families," Symp. Soc. Gen. Microbiol. 24:152-182 (1974).
Hubbard et al., "Modeling studies of the change in conformation required for cleavage of limited proteolytic sites," Protein Science 3:757-768 (1994).
Kyrieleis et al., "Crystal structure of the catalytic domain of DESC1, a new member of the type II transmembrane serine proteinase family," FEBS Journal 274:2148-2160 (2007).
Lin et al., "A novel human dendritic-cell derived Clr-like serine protease analog inhibits complement-mediated cytotoxicity," Biochem and Biophys Res Comm 321(2):329-336 (2004).
Lin, C., et al., "Molecular cloning of cDNA for matriptase, a matrix-degrading serine protease with tryspin-like activity," Journal of Biological Chemistry, 274:18231-18236, (1999).
Netzel-Arnett et al., "Membrane anchored serine proteases: a rapidly expanding group of cell surface proteolytic enzymes with potential roles in cancer," Cancer Metastasis Rev. 22(2-3):237-58 (2003).
Rawlings et al., "Families of serine proteases," Meth Enzymol 244:19-61 (1994).
Richardson, J., "The anatomy and taxonomy of protein structure ," Adv. Prot. Chem., 34:167-339 (1981).
Rosenberg et al., "New insights into hypercoagulable states," Hosp. Prac. 21:131-137 (1986).
Schecter, I. and A. Berger, "On the size of the active site in proteases. I. Papain," Biochem Biophys Res Commun 27:157-162 (1967).
Strassburger et al., "Adaptation of plasminogen activator sequences to known protease structures," FEBS Lett. 157:219-223 (1983).
Stroud, R., "A family of protein-cutting proteins," Sci. Am., 231: 24-88 (1974).
Takeuchi et al., "Cellular localization of membrane-type serine protease 1 and identification of protease-activated receptor-2 and single-chain urokinase-type plasminogen activator as substrates," J Biol Chem., 275(34):26333-26342 (2000).
Wang et al., "Crystal structure of thrombin-ecotin reveals conformational changes and extended interactions," Biochemistry 40(34):10038-10046 (2001).
Xue et al., "Comparison of the effects of Apo(a) kringle IV-10 and plasminogen kringles on the interactions of lipoprotein(a) with regulatory molecules" Thromb Haemost. 81(3):428-35 (1999).
Xue et al., "The Kringle V-protease domain is a fibrinogen binding region within Apo(a)" Thromb Haemost. 86(5):1229-1237 (2001).
Zhang et al., "Distinct contributions of residue 192 to the specificity of coagulation and fibrinolytic serine proteases," J Biol Chem. 274(11):7153-7156 (1999).
Zoog et al., "Baculovirus apoptotic suppressor P49 is a substrate inhibitor of initiator caspases resistant to P35 in vivo" The EMBO Journal 21:5130-5140 (2002).
Ator et al., "Mechanism-based (suicide) enzyme inactivation," In: The Enzymes, Eds. Sigman, D.S. And Boyer, P.D., Academic Press, pp. 213-282 (1990).
Galkin et al., "CVS-3983, a selective matriptase inhibitor, suppresses the growth of androgen independent prostate tumor xenografts," Prostate 61(3):228-235 (2004).
Otlewski et al., "The many faces of protease-protein inhibitor interaction," The EMBO J. 24:1303-1310 (2005).
Ryu et al., "The native strains in the hydrophobic core and flexible reactive loop of a serine protease inhibitor: crystal structure of an uncleaved α1-antitrypsin at 2.7Å," Structure 4:1181-1192 (1996).
Rzychon et al., "Modes of inhibition of cysteine proteases," Acta Biochimica Polonica 51:861-873 (2004).
Takeuchi et al., "Reverse biochemistry: use of macromolecular protease inhibitors to dissect complex biological processes and identify a membrane-type serine protease in epithelial cancer and normal tissue," Proceedings of the National Academy of Sciences of the United States of America, 96:11054-11061(1999).
Xu et al., "Mutational analyses of the p35-caspase interaction. A bowstring kinetic model of caspase inhibition by p35," J. Biol. Chem. 278(7):5455-5461 (2003).
Xu et al., "Covalent inhibition revealed by the crystal structure of the caspase-8/p35 complex," Nature 410:494-497 (2001).
Berkenpas et al., "Molecular evolution of plasminogen activator inhibitor-1 functional stability," The EMBO Journal 14(13):2969-2977 (1995).
Bourgeois et al., "Serpin-derived peptide substrates for investigating the substrate specificity of human tissue kallikreins hK1 and hK2," J Biol Chem 272:29590-29595 (1997).
Buck et al. "Networks of coevolving sites in structural and functional domains of serpin proteins," Mol. Biol. Evol. 22:1627-1634 (2005).
Carrell et al. In: Proteinase Inhibitors, Ed. Barrett, A.J. et al., Elsevier, Amsterdam, pp. 403-420 (1986).
Chang et al., "Probing serpin reactive-loop conformations by proteolytic cleavage," Biochem. J. 314:647-653 (1996).
Declerck et al., "Identification of a conformationally distinct form of plasminogen activator inhibitor-1, acting as a noninhibitory substrate for tissue-type plasminogen activator," J. Biol. Chem. 267:11693-11696 (1992).
Egelund et al., "A serpin-induced extensive proteolytic susceptibility of urokinase-type plasminogen activator implicates distortion of the proteinase substrate-binding pocket and oxyanion hole in the serpin inhibitory mechanism," Eur. J. Biochem. 268:673-685 (2001).
Felber et al., "Mutant recombinant serpins as highly specific inhibitors of human kallikrein 14," FEBS Journal 273:2505-2514 (2006).
Ginsberg et al., "cDNA cloning of human plasminogen activator-inhibitor from endothelial cells," J. Clin. Invest., 78:1673-1680 (1980).
Hekman et al., "Kinetic analysis of the interactions between plasminogen activator inhibitor 1 and both urokinase and tissue plasminogen activator," Arch. Biochem. Biophys. 262:199-210 (1988).
Hopkins et al., "Inhibitory mechanism of serpins," J Biol Chem 272:3905-3909 (1997).
Huntington et al., "Mechanisms of glycosaminoglycan activation of the serpins in hemostasis," J. Thrombosis and Haemostasis 1:1535-1549 (2003).
Huntington et al., "Structure of a serpin-protease complex shows inhibition by deformation," Nature 407:923-926 (2000).
Katagiri et al., "Bovine endothelial cell plasminogen activator inhibitor. Purification and heat activation," Eur J. Biochem. 176:81-87 (1988).
Kvassman et al., "Inhibitory mechanism of serpins: loop insertion forces acylation of plasminogen activator by plasminogen activator inhibitor-1," Biochemistry 37:15491-15502 (1998).
Law et al., "An overview of the serpin superfamily," Genome Biology 7(216):1-11 (2006).
Lawrence et al., "Partitioning of serpin-proteinase reactions between stable inhibition and substrate cleavage is regulated by the rate of serpin reactive center loop insertion into β-sheet A," J Biol. Chem. 275:5839-5844 (2000).
Lee et al., "Regulation of protein function by native metastability," PNAS 97:7727-7731 (2000).
Li et al., " Matrix metalloproteinase-26 is associated with estrogen-dependent malignancies and targets alpha1-antitrypsin serpin," Cancer Res. 64:8657-8665 (2004).
Lucore et al., "Interactions of tissue-type plasminogen activator with plasma inhibitors and their pharmacologic implications," Circ. 77:660-669 (1988).
Madison, "Studies of serpins unfold at a feverish pace" J Clin Invest 94:2174-2175 (1994).
Masumoto et al., "Inhibitory mechanism of a cross-class serpin, the squamous cell carcinoma antigen 1," J Biol Chem 278:45296-45304 (2003).
Orth et al., "Complexes of tissue-type plasminogen activator and its serpin inhibitor plasminogen-activator inhibitor type 1 are internalized by means of the low density lipoprotein receptor-related protein/ alpha 2-macroglobulin receptor," Proc. Natl. Acad. Sci. USA 89:7422-7426 (1992).

Pannekoek et al., "Endothelial plasminogen activator inhibitor (PAI): a new member of the Serpin gene family," EMBO J. 5:2539-2544 (1986).

Potempa et al., "The serpin superfamily of proteinase inhibitors: structure, function, and regulation" J Biol Chem 269:15957-15960 (1994).

Ranby et al., "Enzymatic properties of the one- and two-chain form of tissue plasminogen activator," Throm. Res. 27:175-183 (1982).

Salonen et al., "Interaction of plasminogen activator inhibitor (PAI-1) with vitronectin," (1988) J Biol. Chem., 264:6339-6343 (1988).

Schick et al., "Cross-class inhibition of the cysteine proteinases cathepsins K, L, and S by the serpin squamous cell carcinoma antigen 1: a kinetic analysis," Biochemistry, 37:5258-5266 (1998).

Simonovic et al., "Crystal structure of viral serpin crmA provides insights into its mechanism of cysteine proteinase inhibition" Protein Science 9:1423-1427 (2000).

Taeye et al., "Immobilization of the distal hinge in the labile serpin plasminogen activator inhibitor 1" J Biol Chem 278:23899-23905 (2003).

Travis et al., "Serpins: structure and mechanism of action," Biol. Chem. Hoppe Seyler, 371:3-11 (1990).

Whisstock et al., "Serpins 2005—fun between the β-sheets" FEBS Journal, 272: 4868-4873 (2005).

Wilczynska et al., "Structural insights into serpin-protease complexes reveal the inhibitory mechanism of serpins" Nature Structural Biology 4:354-357 (1997).

Wilczynska et al., "The inhibition mechanism of serpins," J Biol Chem 270:29652-29655 (1995).

Ye et al., "The structure of a Michaelis serpin-protease complex," Nature Structural Biology 8:979-983 (2001).

Zhou et al., "The serpin inhibitory mechanism is critically dependent on the length of the reactive center loop," J. Biol. Chem., 276:27541-27547 (2001).

Barbas et al., "Assembly of combinatorial antibody libraries on phage surfaces: the gene III site," PNAS 88:7978-7982 (1991).

Beck et al., "Identification of efficiently cleaved substrates for HIV-1 protease using a phage display library and use in inhibitor development," Virology 274(2):391-401 (2000).

Blaney and Martin, "Computational approaches for combinatorial library design and molecular diversity analysis," Curr. Opin. Chem. Biol. 1(1):54-59 (1997).

Cahill, J., "Protein and antibody arrays and their medical applications," Immunol. Meth. 250:81-91 (2001).

Chen and Georgiou, "Cell-Surface display of heterologous proteins: From high-throughput screening to environmental applications," Biotechnol Bioeng 79: 496-503 (2002).

Clackson et al., "Making antibody fragments using phage display libraries," Nature 352:624-628 (1991).

de Haard et al., "A large non-immunized human Fab fragment phage library that permits rapid isolation and kinetic analysis of high affinity antibodies," J. Biol. Chem 274:18218-18230 (1999).

Ernst et al., "Baculovirus surface display: construction and screening of a eukaryotic epitope library," Nucleic Acids Research 26(7):1718-1723 (1998).

Francisco, J. and G. Georgiou, "The expression of recombinant proteins on the external surface of *Escherichia coli*. Biotechnological applications," Ann N Y Acad Sci. 745:372-382 (1994).

Freeman et al., "Screening of large protein libraries by the cell immobilized on adsorbed bead approach," Biotechnol. Bioeng. 86:196-200 (2004).

Furka et al., "General method for rapid synthesis of multicomponent peptide mixtures," Int. J. Peptide Protein Res. 37:487-493 (1991).

Garrard et al., "Fab assembly and enrichment in a monovalent phage display system," Bio/Technology 9:1373-1377 (1991).

Georgiou et al., "Display of beta-lactamase on the *Escherichia coli* surface: outer membrane phenotypes conferred by Lpp'-OmpA'-beta-lactamase fusions," Protein Eng. 9:239-247 (1996).

Georgiou et al., "Display of heterologous proteins on the surface of microorganisms: from the screening of combinatorial libraries to live recombinant vaccines," Nat. Biotechnol. 15:29-34 (1997).

Gram et al., "In vitro selection and affinity maturation of antibodies from a naive combinatorial immunoglobulin library," PNAS 89:3576-3580 (1992).

Griffiths et al., "Human anti-self antibodies with high specificity from phage display libraries," EMBO J 12:725-734 (1993).

Hanes and Pluckthun, "In vitro selection and evolution of functional proteins by using ribosome display," Proc. Natl. Acad. Sci. U.S.A. 13:4937-4942 (1997).

Hawkins et al., "Selection of phage antibodies by binding affinity. Mimicking affinity maturation," J Mol Biol 226:889-896 (1992).

Hay et al., "Bacteriophage cloning and *Escherichia coli* expression of a human IgM Fab," Hum Antibod Hybridomas 3:81-85 (1992).

Hoess, "Protein design and phage display," Chem Rev 101:3205-3218 (2001).

Houghten et al., "Generation and use of synthetic peptide combinatorial libraries for basic research and drug discovery," Nature 354:84-86 (1991).

Huse et al., "Generation of a large combinatorial library of the immunoglobulin repertoire in phage lambda," Science 246:1275-1281 (1989).

Kim et al., "Bacterial cell surface display of an enzyme library for selective screening of improved cellulase variants," Appl Environ Microbiol. 66:788-793 (2000).

Klauser et al., "Extracellular transport of cholera toxin B subunit using Neisseria IgA protease beta-domain: conformation-dependent outer membrane translocation," EMBO J. 1991-1999 (1990).

Lam et al., "A new type of synthetic peptide library for identifying ligand-binding activity," Nature, 354,82-84 (1991).

Lam et al., "The "One-Bead-One-Compound" Combinatorial Library Method," Chem. Rev. 97:411-448 (1997).

Lam, K., "Application of combinatorial library methods in cancer research and drug discovery," Anticancer Drug Des. 12(3):145-167 (1997).

Lasters et al., "Enzymatic properties of phage-displayed fragments of human plasminogen" Eur J Biochem. 244(3):946-52 (1997).

Lattemann et al., "Autodisplay: functional display of active beta-lactamase on the surface of *Escherichia coli* by the AIDA-I autotransporter," J Bacteriol. 182(13):3726-3733 (2000).

June et al. "Surface display of Zymomonas mobilis levansucrase by using the ice-nucleation protein of Pseudomonas syringae," Nat Biotechnol. 16:576-580 (1998).

MacBeath et al., "Redesigning enzyme topology by directed evolution," Science 279:1958-1961 (1998).

Maurer et al., "Autodisplay: one-component system for efficient surface display and release of soluble recombinant proteins from *Escherichia coli*," J Bacteriol. 179:794-804 (1997).

Olsen et al., "High-throughput screening of enzyme libraries," Curr Opin in Biotech 11(4):331-337 (2000).

Rebar et al., "Phage display methods for selecting zinc finger proteins with novel DNA-binding specificities,"Methods Enzymol. 267:129-149 (1996).

Rodi et al., "One from column A and two from column B: the benefits of phage display in molecular-recognition studies," Curr. Opin. Chem. Biol. 6:92-96 (2002).

Samuelson et al., "Display of proteins on bacteria," J. Biotechnol. 96:129-154 (2002).

Schultz, J. and J. Schultz, "The combinatorial library: a multifunctional resource," Biotechnol. Prog. 12(6):729-743 (1996).

Shikata et al., "Characterization of secretory intermediates of Serratia marcescens serine protease produced during its extracellular secretion from *Escherichia coli* cells," J Biochem. 114:723-731 (1993).

Smith and Petrenko "Phage display," Chem Rev 97:391-410 (1997).

Smith, G., "Filamentous fusion phage: novel expression vectors that display cloned antigens on the virion surface," Science 228:1315-1317 (1985).

Soumillion and Fastrez, "Investigation of phage display for the directed evolution of enzymes," In: Directed Molecular Evolution of Proteins or How to Improve Enzymes for Biocatalysis, Eds. Brackmann, S. and Johnsson, K., Wiley-VCH, pp. 79-110 (2002).

Soumillion et al., "Phage display of enzymes and in vitro selection for catalytic activity," Appl. Biochem. Biotechnol. 47:175-189 (1994).

Suzuki T et al., "Extracellular transport of VirG protein in Shigella," J Biol Chem. 270:30874-30880 (1995).

Tietze, L. and M. Lieb, "Domino reactions for library synthesis of small molecules in combinatorial chemistry," Curr. Opin. Chem. Biol. 2(3):363-371 (1998).

Wang et al., "Phage display of proteases and macromolecular inhibitors," Methods Enzymol. 267:52-68 (1996).

Andris-Widhopf et al., Methods for the generation of chicken monoclonal antibody fragments by phage display, J Immunol Methods, 28:159-181 (2000).

Boublik et al., "Eukaryotic Virus Display: Engineering the Major Surface Glycoproteins of the Autographa California Nuclear Polyhedrosis Virus (ACNPV) for the Presentation of Foreign Proteins on the Virus Surface," Bio/Technology, 13:1079-1084 (1995).

Corey et al., "Trypsin display on the surface of bacteriophage," Gene 128(1):129-134 (1993).

Crameri et al., "Display of biologically active proteins on the surface of filamentous phages: a cDNA cloning system for selection of functional gene products linked to the genetic information responsible for their production," Gene 137:69-75 (1993).

Cwirla et al., "Peptides on phage: a vast library of peptides for identifying ligands," Proc Natl Acad Sci USA 87(16):6378-6382 (1990).

Fowlkes et al., "Multipurpose vectors for peptide expression on the M13 viral surface," Biotechniques 13(3):422-428 (1992).

Glaser et al., "Antibody Engineering by Condon-Based Mutagenesis in a Filamentous Phage Vector System," J. Immunol. 149:3903-3913 (1992).

Hoogenboom et al., "Antibody phage display technology and its applications," Immunotechnology 4:1-20 (1998).

Hoogenboom et al., "Multi-Subunit Proteins on the Surface of Filamentous Phage: Methodologies for Displaying Antibody (Fate) Heavy and 30 Light Chains," Nucleic Acids Res., 19:4133-4137 (1991).

Hoogenboom et al., "Natural and designer binding sites made by phage display technology," Immunol Today 2:371-378 (2000).

Houshmand et al., "Use of bacteriophage T7 displayed peptides for determination of monoclonal antibody specificity and biosensor analysis of the binding reaction," Anal Biochem 268:363-370 (1999).

Marvin, D., "Filamentous phage structure, infection and assembly," Curr. Opin. Struct. Biol. 8:150-158 (1998).

McCafferty et al., "Phage antibodies: filamentous phage displaying antibody variable domains," Nature 348(6301):552-554 (1990).

McConnell et al., "Constrained peptide libraries as a tool for finding mimotopes," Gene 151(1-2):115-118 (1994).

Santini, C., "Efficient display of an HCV cDNA expression library as C-terminal fusion to the capsid protein D of bacteriophage lambda," J. Mol. Biol. 282:125-135 (1998).

Scott, J. And G. Smith, "Searching for peptide ligands with an epitope library," Science 249(4967):386-390 (1990).

Sidhu et al., "High copy display of large proteins on phage for functional selections," J. Mol. Biol. 296:487-495 (2000).

Zanghi et al., "A simple method for displaying recalcitrant proteins on the surface of bacteriophage lambda," Nuc. Acid Res. 33(18)e160:1-8 (2005).

Amanna and Brosius, "ATG vectors' for regulated high-level expression of cloned genes in *Escherichia coli*," Gene 40:183-190 (1985).

Brosius, J. "Toxicity of an overproduced foreign gene product in *Escherichia coli* and its use in plasmid vectors for the selection of transcription terminators," Gene 27:161-172 (1984).

Growl et al., "Versatile expression vectors for high-level synthesis of cloned gene products in *Escherichia coli*," Gene, 38:31-38 (1985).

Elvin et al., "Modified bacteriophage lambda promoter vectors for overproduction of proteins in *Escherichia coli*," Gene 37:123-126 (1990).

Guzman et al., "FtsL, an essential cytoplasmic membrane protein involved in cell division in *Escherichia coli*," J. Bacteriol. 174:7716-7728 (1992).

Haldimann et al., "Use of new methods for construction of tightly regulated arabinose and rhamnose promoter fusions in studies of the *Escherichia coli* phosphate regulon," J. Bacteriol. 180:1277-1286 (1998).

Lutz and Bujard, "Independent and tight regulation of transcriptional units in *Escherichia coli* via the LacR/O, the TetR/O and AraC/I1-I2 regulatory elements," Nucl. Acids. Res. 25:1203-1210 (1997).

Tabor and Richardson, "A Bacteriophage T7 RNA Polymerase/Promoter System for Controlled Exclusive Expression of Specific Genes," Proc. Natl. Acad. Sci. U.S.A. 82:1074-1078 (1985).

Windass et al., "The construction of a synthetic *Escherichia coli* trp promoter and its use in the expression of a synthetic interferon gene," Nucl. Acids. Res. 10:6639-6657 (1982).

Buerke et al., "Novel small molecule inhibitor of C1s exerts cardioprotective effects in ischemia-reperfusion injury in rabbits," J Immunol 167:5375-5380 (2001).

Dodds, W., "Animal models for the evolution of thrombotic disease," Annals of the NewYork Academy of Sciences 516:631-635 (1987).

Fong, "Inhibition of tumor growth, angiogenesis, and microcirculation by the novel Flk-1 inhibitor SU5416 as assessed by intravital multi-fluorescence videomicroscopy," Neoplasia 1(1):31-41 (1999). Erratum in: Neoplasia 1(2):183 (1999).

Gravanis and Tsirka "Tissue plasminogen activator and glial function," GLIA 49:177-183 (2005).

Grenier, D. and D. Mayrand, "Selected characteristics of pathogenic and nonpathogenic strains of Bacteroides gingivalis," Journal of Clinical Microbiology, 25:738-740 (1987).

Kesslak, J and H. Keirstead, "Assessment of behavior in animal models of spinal cord injury," J Spinal Cord Med. 26:323-328 (2003).

Kim et al., "Inhibition of vascular endothelial growth factor-induced angiogenesis suppresses tumour growth in vivo," Nature 362(6423):841-844 (1993).

Klement et al., "Continuous low-dose therapy with vinblastine and VEGF receptor-2 antibody induces sustained tumor regression without overt toxicity," J Clin Invest. 105(8):R15-24 (2000).

Krueger and Busch, "Protocol of a thromboembolic stroke model in the rat: review of the experimental procedure and comparison of models," Invest. Radiol. 37:600-608 (2002).

Lavigne et al., "Thrombophilic families with inheritably associated high levels of coagulation factors VIII, IX and XI," J. Thromb. Haemost. 1:2134-2130 (2003).

Lin et al., "Inhibition of tumor growth by targeting tumor endothelium using a soluble vascular endothelial growth factor receptor," Cell Growth Differ. 9(1):49-58 (1998).

Marsh, et al., "Ultrastructure and enzyme activities of a virulent and an avirulent variant of Bacteroides gingivalis W50," FEMS Microbiol. 59:181-185 (1989).

Martinez-Arizala, A., "Methods to measure sensory function in humans versus animals," J Rehabil. Res. Dev. 40:35-39 (2003).

McMahon, G., "VEGF receptor signaling in tumor angiogenesis," Oncologist 5 Suppl 1:3-10 (2000).

Millauer et al., "Glioblastoma growth inhibited in vivo by a dominant-negative Flk-1 mutant," Nature 367(6463):576-579 (1994).

Mizuno et al., "Soluble complement receptor type 1 protects rats from lethal shock induced by anti-Crry antibody following lipopolysaccharide priming," Int Arch Allergy Immunol 127:55-62 (2002).

Petersen et al., "An assay for the mannan-binding lectin pathway of complement activation," J Immunological Meth., 257:107-116 (2001).

Piddlesden et al., "Soluble recombinant complement receptor 1 inhibits inflammation and demyelination in antibody-mediated demyelinating experimental allergic encephalomyelitis," J Immunol 152:5477-5484 (1994).

Potempa et al., "Comparative properties of two cysteine proteinases (gingipains R), the products of two related but individual genes of Porphyromonas gingivalis," J. Biol. Chem. 273:21648-21657 (1998).

Prewett et al., "Antivascular endothelial growth factor receptor (fetal liver kinase 1) monoclonal antibody inhibits tumor angiogenesis and growth of several mouse and human tumors," Cancer Res. 59(20):5209-5218 (1999).

Ribatti et al., "Angiogenesis and anti-angiogenesis in hematological malignancies," J Hemather Stem Cell Res. 12(1):11-22 (2003).

Render et al., "Blockade of C5a and C5b-9 generation inhibits leukocyte and platelet activation during extracorporeal circulation," J. Clin. Invest. 96:1564-1572 (1995).

Shaheen et al., "Antiangiogenic therapy targeting the tyrosine kinase receptor for vascular endothelial growth factor receptor inhibits the growth of colon cancer liver metastasis and induces tumor and endothelial cell apoptosis," Cancer Res. 59(21):5412-5416 (1999).

Smalley et al., "The distribution of trypsin-like enzyme activity in cultures of a virulent and an avirulent strain of *Bacteroides gingivalis* W50," Oral Microbiology and Immunology 4:178-181 (1989).

Szalai et al., "The Arthus reaction in rodents: species-specific requirement of complement," J Immunol 164:463 (2000).

Thomas, C. and B. Noga, "Physiological methods to measure motor function in humans and animals with spinal cord injury," J Rehabil. Res. Dev. 40:25-33 (2003).

Waltenberger et al., "Different signal transduction properties of KDR and Flt1, two receptors for vascular endothelial growth factor," J Biol Chem. 269(43):26988-26995 (1994).

Wang et al., "Anti-C5 monoclonal antibody therapy prevents collagen-induced arthritis and ameliorates established disease," PNAS 92:8955 (1995).

Webb et al., "Behavioural analysis of the efficacy of treatments for injuries to the spinal cord in animals," Vet. Rec. 155:225-230 (2004).

Weinberg, M. and M. Bral, "Laboratory animal models in periodontology," J. of Periodontology 26(6), 335-340 (1999).

Weltermann et al., "The risk of recurrent venous thromboembolism among patients with high factor IX levels" Journal of Thrombosis and Haemostasis 1(1):28-32 (2003); Comment in Journal of Thrombosis and Haemostasis 1(1):16-18 (2003).

Yoshiji, "KDR/Flk-1 is a major regulator of vascular endothelial growth factor-induced tumor development and angiogenesis in murine hepatocellular carcinoma cells," Hepatology 30(5):1179-1186 (1999).

Brady et al., "Therapeutic and diagnostic uses of modified monoclonal antibodies," Int. J. Rad. Oncol. Biol. Phys. 13:1535-1544 (1987).

Dillman, R., "Monoclonal antibodies in the treatment of cancer," in CRC Critical Reviews in Oncology/Hematology 1:357-385 CRC Press, Inc. (1984).

Pastan et al., "Immunotoxins," Cell 47:641-648 (1986).

Vitetta et al., "Redesigning nature's poisons to create anti-tumor reagents," Science 238:1098-1104 (1987).

Wawrzynczak and Thorpe in Introduction to the Cellular and Molecular Biology of Cancer, L. M. Franks and N. M. Teich, eds, Chapter 18, pp. 378-410, Oxford University Press. Oxford (1986).

Tyle, P., "Iontophoretic devices for drug delivery," Pharmaceutical Research 3(6):3-18 (1986).

Benhar et al., "Pseudomonas exotoxin A mutants. Replacement of surface-exposed residues in domain III with cysteine residues that can be modified with polyethylene glycol in a site-specific manner," J. Biol. Chem. 269:13398-14404 (1994).

Brumeanu et al., "Derivatization with monomethoxypolyethylene glycol of Igs expressing viral epitopes obviates adjuvant requirements," J Immunol., 154: 3088-3095 (1995).

Caliceti et al., "Pharmacokinetic and biodistribution properties of poly(ethylene glycol)-protein conjugates," Adv. Drug Deliv. Rev. 55(10):1261-1277 (2003).

Cheng et al., "PEGylated adenoviruses for gene delivery to the intestinal epithelium by the oral route," Pharm. Res. 20(9):1444-14451 (2003).

Felix et al., "Pegylated peptides. IV. Enhanced biological activity of site-directed pegylated GRF analogs," Int. J. Peptide Res. 46:253-264 (1995).

Lu, Y. and A. Felix, "Pegylated peptides. II. Solid-phase synthesis of amino-, carboxy- and side-chain pegylated peptides," Int. J. Peptide Protein Res. 43:127-138 (1994).

Lu, Y. and A. Felix, "Pegylated peptides I: Solid-phase synthesis of N alpha-pegylated peptides using Fmoc strategy," Peptide Res 6:140-146 (1993).

Molineux, G., "Pegylation: engineering improved biopharmaceuticals for oncology," Pharmacotherapy 23 (8 Pt 2):3S-8S (2003).

Adams et al., "The c-myc oncogene driven by immunoglobulin enhancers induces lymphoid malignancy in transgenic mice," Nature 318:533-538 (1985).

Alexander et al., "Expression of the c-myc oncogene under control of an immunoglobulin enhancer in E mu-myc transgenic mice," Mol. Cell Biol. 7:1436-1444 (1987).

Bemoist, C. and P. Chambon, "In vivo sequence requirements of the SV40 early promotor region," Nature 290:304-310 (1981).

Brinster et al., "Regulation of metallothionein—thymidine kinase fusion plasmids injected into mouse eggs," Nature 296:39-42 (1982).

DeBoer et al., "The tac promoter: a functional hybrid derived from the tip and lac promoters," Proc. Natl. Acad. Sci. USA 80:21-25 (1983).

Gardner et al., "The complete nucleotide sequence of an infectious clone of cauliflower mosaic virus by M13mp7 shotgun sequencing," Nucleic Acids Res. 9:2871-2888 (1981).

Gilbert, W. and L. Villa-Komaroff, "Useful Proteins from Recombinant Bacteria," Scientific American 242:79-94 (1980).

Grosschedl et al., "Introduction of a mu immunoglobulin gene into the mouse germ line: specific expression in lymphoid cells and synthesis of functional antibody," Cell 38:647-658 (1984).

Hammer et al., "Diversity of alpha-fetoprotein gene expression in mice is generated by a combination of separate enhancer elements," Science 235:53-58 (1987).

Hanahan, D., "Heritable formation of pancreatic beta-cell tumours in transgenic mice expressing recombinant insulin/simian virus 40 oncogenes," Nature (3)15:115-122 (1985).

Herrera-Estrella et al., "Light-inducible and chloroplast-associated expression of a chimaeric gene introduced into Nicotiana tabacum using a Ti plasmid vector," Nature 310(5973):115-120 (1984).

Jay et al., "Construction of a general vector for efficient expression of mammalian proteins in bacteria: use of a synthetic ribosome binding site," Proc. Natl. Acad. Sci. USA 78:5543 (1981).

Kelsey et al., "Species- and tissue-specific expression of human alpha 1-antitrypsin in transgenic mice," Genes and Devel. 1:161-171 (1987).

Kollias et al., "Regulated expression of human A gamma-, beta-, and hybrid gamma beta-globin genes in transgenic mice: manipulation of the developmental expression patterns," Cell 46:89-94 (1986).

Krumlauf et al., Developmental regulation of alpha-fetoprotein genes in transgenic mice, Mol. Cell. Biol. 5:1639-1648 (1985).

Leder et al., "Consequences of widespread deregulation of the c-myc gene in transgenic mice: multiple neoplasms and normal development," Cell 45:485-495 (1986).

Macdonald, R., "Expression of the pancreatic elastase I gene in transgenic mice," Hepatology 7:42S-51S (1987).

Magram et al., "Developmental regulation of a cloned adult beta-globin gene in transgenic mice," Nature 315(6017):338-340 (1985).

Mason et al., "The hypogonadal mouse: reproductive functions restored by gene therapy," Science 234:1372-1378 (1986).

Mayfield, et al., "Expreession and assembly of a fully active antibody in algae," Proceedings of the National Academy of Sciences of the United States of America, 100:438-442 (2003).

Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).

Pham et al., "Large-scale transient transfection of serum-free suspension-growing HEK293 EBNA1 cells: peptone additives improve cell growth and transfection efficiency," Biotechnology and Bioengineering, 84:332-342, (2003).

Pinkert et al., "An albumin enhancer located 10 kb upstream functions along with its promoter to direct efficient, liver-specific expression in transgenic mice," Genes and Devel. 1:268-276 (1987).

Readhead et al., "Expression of a myelin basic protein gene in transgenic shiverer mice: correction of the dysmyelinating phenotype," Cell 48:703-712 (1987).

Shani, M., "Tissue-specific expression of rat myosin light-chain," Nature 314:283-286 (1985).

Swift et al., "Tissue-specific expression of the rat pancreatic elastase I gene in transgenic mice," Cell 38:639-646 (1984).

Wagner et al., "Nucleotide sequence of the thymidine kinase gene of herpes simplex virus type I," Proc. Natl. Acad. Sci. USA 78:1441-1445 (1981).

Yamamoto et al., "Identification of a functional promoter in the long terminal repeat of Rous sarcoma virus," Cell 22:787-797 (1980).

Asai et al., "Sec-dependent pathway and DeltapH-dependent pathway do not share a common translocation pore in thylakoidal protein transport," J. Biol. Chem. 274:20079-20078 (1999).

Beatty et al., Kinetics of association of serine proteinases with native and oxidized alpha-1-proteinase inhibitor and alpha-1-antichymotrypsinJ. Biol. Chem. 255:3931-3934 (1980).
Benoit et al., "An improved method for fast, robust, and seamless integration of DNA fragments into multiple plasmids," Protein Expression & Purification 45:66-71 (2006).
Blouse et al., "A concerted structural transition in the plasminogen activator inhibitor-1 mechanism of inhibition," Biochemistry 41(40):11997-12009 (2002).
Blouse et al., "Mutation of the highly conserved tryptophan in the serpin breach region alters the inhibitory mechanism of plasminogen activator inhibitor-1," Biochemistry 42(42):12260-12272 (2003).
Chiswell et al., "Phage antibodies: will new 'coliclonal' antibodies replace monoclonal antibodies?" Trends Biotechnol. 10:80-84 (1992).
Cirino et al., "Generating mutant libraries using error-prone PCR," Methods Mol Biol. 231:3-9 (2003).
Crowe et al., "Improved cloning efficiency of polymerase chain reaction (PCR) products after proteinase K digestion," Nucleic Acids Res. 19(1):184 (1991).
Franke et al., "Expression of human plasminogen activator inhibitor type-1 (PAI-1) in *Escherichia coli* as a soluble protein comprised of active and latent forms. Isolation and crystallization of latent PAI-1," Biochimic et Biophysica Acta 1037:16-23 (1990).
Fu et al., "Isolation from phage display libraries of single chain variable fragment antibodies that recognize conformational epitopes in the malaria vaccine candidate, apical membrane antigen-1," J Biol. Chem. 272:25678-25684 (1997).
Fuchs et al., "Targeting recombinant antibodies to the surface of *Escherichia coli*: fusion to a peptidoglycan associated lipoprotein.," Bio/Technology 9:1369-1372 (1991).
Goeddel et al., "Expression in *Escherichia coli* of chemically synthesized genes for human insulin," Proc. Nat. Acad. Sci. U.S.A. 76:106-110 (1979).
Holmes et al., "Characterization of recombinant human alpha 2-antiplasmin and of mutants obtained by site-directed mutagenesis of the reactive site," Biochemistry 26:5133-5140 (1987).
Kvassman et al., "The acid stabilization of plasminogen activator inhibitor-1 depends on protonation of a single group that affects loop insertion into beta-sheet A," J Biol Chem. 270(46):27942-7 (1995).
Levin et al. "Optimizing the affinity and specificity of proteins with molecular display," Molecular BioSystems 2:49-57 (2006).
Matsumura et al., "Mutagenic polymerase chain reaction of protein-coding genes for in vitro evolution," Methods Mol Biol. 182:259-267 (2002).
Olson et al., "Role of the catalytic serine in the interactions of serine proteinases with protein inhibitors of the serpin family," J. Biol. Chem., 270:30007-30017 (1995).
Sancho et al., "Purification and characterization of active and stable recombinant plasminogen-activator inhibitor accumulated at high levels in *Escherichia coli*," Eur. J. Biochem. 224:125-134 (1994).
Shubeita et al., "Mutational and immunochemical analysis of plasminogen activator inhibitor 1," J Biol Chem 265:18379-18385 (1990).
Wybranietz et al., "Distinct combination of purification methods dramatically improves cohesive-end subcloning of PCR products," Biotechniques 24:578-580 (1998).
Zimmerman et al., "Sensitive assays for trypsin, elastase, and chymotrypsin using new fluorogenic substrates," Anal Biochem, 78:47-51 (1977).
Ruan et al., "Overexpression of BsoBI restriction endonuclease in *E. coli*, purification of the recombinant BsoBI, and identification of catalytic residues of BsoBI by random mutagenesis," Gene 188:35-39 (1997).
Zaccolo et al., "An approach to random mutagenesis of DNA using mixtures of triphosphate derivatives of nucleoside analogues," J. Mol. Biol. 255:589-603 (1996).
Zheng et al., "An efficient one-step-site-directed and site-saturation mutagenesis protocol," Nucl. Acids. Res. 32:e115 (2004).
Altschul, S., "Basic local alignment search tool," J Molec Biol 215(3):403-410 (1990).
Carillo, H. and D. Lipman, "The multiple sequence alignment problem in biology," SIAM Journal of Applied Mathematics, 48:1073-1082, (1988).
Devereux, et al., "A comprehensive set of sequence analysis programs for the VAX," Nucleic Acids Research, 12(I):387-399, (1984).
Gribskov, M. and R. Burgess, "Sigma factors from *E. coli, B. subtilis*, phage SP01, and phage T4 are homologous proteins," Nucleic Acids Research, 14:6745-6763, (1986).
IUPAC-IUB, "Abbreviated nomenclature of synthetic poypeptides-polymerized amino acids-revised recommendations," Commission on Biochemical Nomenclature, Biochemistry 11:1726-1731 (1972).
Needleman, S. and C. Wunsch, "A general method applicable to the search for similarities in the amino acid sequence of two proteins," Journal of Molecular Biology, 48:443-453, (1970).
Ostresh et al., "Peptide libraries: determination of relative reaction rates of protected amino acids in competitive couplings," Biopolymers 34:1681-1689 (1994).
Pearson, W. and D. Lipman , "Improved tools for biological sequence comparison," Proceedings of the National Academy of Sciences of the United States of America, 85:2444-2448, (1988).
Schwartz and Dayhoff, eds., Atlas of Protein Sequence and structure, National Biomedical Research Foundation, pp. 353-358 (1979).
Smith, T. and M. Waterman, "Comparison of biosequences," Advances in Applied Mathematics 2:482-489 (1981).
Spatola (1983) pp. 267-357 in Chemistry and Biochemistry of Amino Acids, Peptides, and Proteins, Weinstein, Ed. vol. 7, Marcel Dekker, New York.
NCBI CoreNucleotide AF001464 (accessed Feb. 28, 2007).
NCBI CoreNucleotide AF035251 (accessed Feb. 28, 2007).
NCBI CoreNucleotide AF078105 (accessed Feb. 28, 2007).
NCBI CoreNucleotide AF078533 (accessed Feb. 28, 2007).
NCBI CoreNucleotide AF097874 (accessed Feb. 28, 2007).
NCBI CoreNucleotide AF104357 (accessed Feb. 28, 2007).
NCBI CoreNucleotide AF118224 (accessed Feb. 28, 2007).
NCBI CoreNucleotide AF130356 (accessed Feb. 28, 2007).
NCBI CoreNucleotide AY035311 (accessed Feb. 28, 2007).
NCBI CoreNucleotide D28492 (accessed Feb. 28, 2007).
NCBI CoreNucleotide J04962 (accessed Feb. 28, 2007).
NCBI CoreNucleotide J05229 (accessed Feb. 28, 2007).
NCBI CoreNucleotide K01988 (accessed Feb. 28, 2007).
NCBI CoreNucleotide L29052 (accessed Feb. 28, 2007).
NCBI CoreNucleotide L29506 (accessed Feb. 28, 2007).
NCBI CoreNucleotide M13469 (accessed Feb. 28, 2007).
NCBI CoreNucleotide M14221 (accessed Feb. 28, 2007).
NCBI CoreNucleotide M15203 (accessed Feb. 28, 2007).
NCBI CoreNucleotide M16652 (accessed Feb. 28, 2007).
NCBI CoreNucleotide M17016 (accessed Feb. 28, 2007).
NCBI CoreNucleotide M22870 (accessed Feb. 28, 2007).
NCBI CoreNucleotide M24400 (accessed Feb. 28, 2007).
NCBI CoreNucleotide M25499 (accessed Feb. 28, 2007).
NCBI CoreNucleotide M64743 (accessed Feb. 28, 2007).
NCBI CoreNucleotide M76590 (accessed Feb. 28, 2007).
NCBI CoreNucleotide M80482 (accessed Feb. 28, 2007).
NCBI CoreNucleotide M81431 (accessed Feb. 28, 2007).
NCBI CoreNucleotide M84342 (accessed Feb. 28, 2007).
NCBI CoreNucleotide M87516 (accessed Feb. 28, 2007).
NCBI CoreNucleotide S93414 (accessed Feb. 28, 2007).
NCBI CoreNucleotide U13665 (accessed Feb. 28, 2007).
NCBI CoreNucleotide U13737 (accessed Feb. 28, 2007).
NCBI CoreNucleotide U14647 (accessed Feb. 28, 2007).
NCBI CoreNucleotide U20536 (accessed Feb. 28, 2007).
NCBI CoreNucleotide U28015 (accessed Feb. 28, 2007).
NCBI CoreNucleotide U39613 (accessed Feb. 28, 2007).
NCBI CoreNucleotide U56390 (accessed Feb. 28, 2007).
NCBI CoreNucleotide U59463 (accessed Feb. 28, 2007).
NCBI CoreNucleotide U60519 (accessed Feb. 28, 2007).
NCBI CoreNucleotide U85059 (accessed Feb. 28, 2007).
NCBI CoreNucleotide X03341 (accessed Feb. 28, 2007).
NCBI CoreNucleotide X12451 (accessed Feb. 28, 2007).
NCBI CoreNucleotide X14689 (accessed Feb. 28, 2007).
NCBI CoreNucleotide X17094 (accessed Feb. 28, 2007).
NCBI CoreNucleotide X56955 (accessed Feb. 28, 2007).
NCBI CoreNucleotide X62386 (accessed Feb. 28, 2007).

NCBI CoreNucleotide X98172 (accessed Feb. 28, 2007).
NCBI CoreNucleotide Y12261 (accessed Feb. 28, 2007).
NCBI CoreNucleotide Y13090 (accessed Feb. 28, 2007).
NCBI CoreNucleotide Y14734 (accessed Feb. 28, 2007).
NCBI CoreNucleotide 248810 (accessed Feb. 28, 2007).
NCBI Nucleotide AB048796 (accessed on Feb. 27, 2007).
NCBI Nucleotide AC005570 (Cosmid 407D8) (accessed on Feb. 27, 2007).
NCBI Nucleotide AF064819 (accessed on Feb. 27, 2007).
NCBI Nucleotide AF284421 (accessed on Feb. 27, 2007).
NCBI Nucleotide AJ007331 (accessed on Feb. 27, 2007).
NCBI Nucleotide AK075142 (accessed on Feb. 27, 2007).
NCBI Nucleotide AL136097 (RP11-62C3 clone) (accessed on Feb. 27, 2007).
NCBI Nucleotide BC035384 (accessed on Feb. 27, 2007).
NCBI Nucleotide BC036846 (accessed on Feb. 27, 2007).
NCBI Nucleotide BC041609 (accessed on Feb. 27, 2007).
NCBI Nucleotide BC048112 (accessed on Feb. 27, 2007).
NCBI Nucleotide BN000120 (accessed on Feb. 27, 2007).
NCBI Nucleotide BN000128 (accessed on Feb. 27, 2007).
NCBI Nucleotide BN000133 (accessed on Feb. 27, 2007).
NCBI Nucleotide NM_000128 (accessed on Feb. 27, 2007).
NCBI Nucleotide NM_000131 (accessed on Feb. 27, 2007).
NCBI Nucleotide NM_000133 (accessed on Feb. 27, 2007).
NCBI Nucleotide NM_000301 (accessed on Feb. 27, 2007).
NCBI Nucleotide NM_000312 (accessed on Feb. 27, 2007).
NCBI Nucleotide NM_000504 (accessed on Feb. 27, 2007).
NCBI Nucleotide NM_000505 (accessed on Feb. 27, 2007).
NCBI Nucleotide NM_000506 (accessed on Feb. 27, 2007).
NCBI Nucleotide NM_000892 (accessed on Feb. 27, 2007).
NCBI Nucleotide NM_000930 (accessed on Feb. 27, 2007).
NCBI Nucleotide NIVI_000931 (accessed on Feb. 27, 2007).
NCBI Nucleotide NM_001002231 (accessed on Feb. 27, 2007).
NCBI Nucleotide NM_001002232 (accessed on Feb. 27, 2007).
NCBI Nucleotide NM_001012964 (accessed on Feb. 27, 2007).
NCBI Nucleotide NM_001012965 (accessed on Feb. 27, 2007).
NCBI Nucleotide NM_001012966 (accessed on Feb. 27, 2007).
NCBI Nucleotide NM_001030047 (accessed on Feb. 27, 2007).
NCBI Nucleotide NM_001030048 (accessed on Feb. 27, 2007).
NCBI Nucleotide NM_001030049 (accessed on Feb. 27, 2007).
NCBI Nucleotide NM_001030050 (accessed on Feb. 27, 2007).
NCBI Nucleotide NM_001097 (accessed on Feb. 27, 2007).
NCBI Nucleotide NM_001528 (accessed on Feb. 27, 2007).
NCBI Nucleotide NM_001648 (accessed on Feb. 27, 2007).
NCBI Nucleotide NM_001836 (accessed on Feb. 27, 2007).
NCBI Nucleotide NM_001907 (accessed on Feb. 27, 2007).
NCBI Nucleotide NM_001911 (accessed on Feb. 27, 2007).
NCBI Nucleotide NM_001971 (accessed on Feb. 27, 2007).
NCBI Nucleotide NM_001972 (accessed on Feb. 27, 2007).
NCBI Nucleotide NM_002104 (accessed on Feb. 27, 2007).
NCBI Nucleotide NM_002151 (accessed on Feb. 27, 2007).
NCBI Nucleotide NM_002257 (accessed on Feb. 27, 2007).
NCBI Nucleotide NM_002658 (accessed on Feb. 27, 2007).
NCBI Nucleotide NM_002769 (accessed on Feb. 27, 2007).
NCBI Nucleotide NM_002770 (accessed on Feb. 27, 2007).
NCBI Nucleotide NM_002771 (accessed on Feb. 27, 2007).
NCBI Nucleotide NM_002772 (accessed on Feb. 27, 2007).
NCBI Nucleotide NM_002773 (accessed on Feb. 27, 2007).
NCBI Nucleotide NM_002774 (accessed on Feb. 27, 2007).
NCBI Nucleotide NM_002776 (accessed on Feb. 27, 2007).
NCBI Nucleotide NM_002777 (accessed on Feb. 27, 2007).
NCBI Nucleotide NM_003294 (accessed on Feb. 27, 2007).
NCBI Nucleotide NM_003619 (accessed on Feb. 27, 2007).
NCBI Nucleotide NM_004132 (accessed on Feb. 27, 2007).
NCBI Nucleotide NM_004262 (accessed on Feb. 27, 2007).
NCBI Nucleotide NM_004917 (accessed on Feb. 27, 2007).
NCBI Nucleotide NM_005046 (accessed on Feb. 27, 2007).
NCBI Nucleotide NM_005317 (accessed on Feb. 27, 2007).
NCBI Nucleotide NM_005551 (accessed on Feb. 27, 2007).
NCBI Nucleotide NM_005656 (accessed on Feb. 27, 2007).
NCBI Nucleotide NM_005747 (accessed on Feb. 27, 2007).
NCBI Nucleotide NM_006144 (accessed on Feb. 27, 2007).
NCBI Nucleotide NM_006587 (accessed on Feb. 27, 2007).
NCBI Nucleotide NM_006799 (accessed on Feb. 27, 2007).
NCBI Nucleotide NM_006853 (accessed on Feb. 27, 2007).
NCBI Nucleotide NM_007173 (accessed on Feb. 27, 2007).
NCBI Nucleotide NM_007196 (accessed on Feb. 27, 2007).
NCBI Nucleotide NM_007272 (accessed on Feb. 27, 2007).
NCBI Nucleotide NM_007352 (accessed on Feb. 27, 2007).
NCBI Nucleotide NM_012217 (accessed on Feb. 27, 2007).
NCBI Nucleotide NM_012315 (accessed on Feb. 27, 2007).
NCBI Nucleotide NM_012427 (accessed on Feb. 27, 2007).
NCBI Nucleotide NM_012467 (accessed on Feb. 27, 2007).
NCBI Nucleotide NM_015596 (accessed on Feb. 27, 2007).
NCBI Nucleotide NM_015849 (accessed on Feb. 27, 2007).
NCBI Nucleotide NM_017509 (accessed on Feb. 27, 2007).
NCBI Nucleotide NM_019559 (accessed on Feb. 27, 2007).
NCBI Nucleotide NM_019598 (accessed on Feb. 27, 2007).
NCBI Nucleotide NM_019616 (accessed on Feb. 27, 2007).
NCBI Nucleotide NM_019894 (accessed on Feb. 27, 2007).
NCBI Nucleotide NM_022046 (accessed on Feb. 27, 2007).
NCBI Nucleotide NM_022119 (accessed on Feb. 27, 2007).
NCBI Nucleotide NM_023006 (accessed on Feb. 27, 2007).
NCBI Nucleotide NM_024022 (accessed on Feb. 27, 2007).
NCBI Nucleotide NM_024164 (accessed on Feb. 27, 2007).
NCBI Nucleotide NM_030770 (accessed on Feb. 27, 2007).
NCBI Nucleotide NM_031948 (accessed on Feb. 27, 2007).
NCBI Nucleotide NM_032401 (accessed on Feb. 27, 2007).
NCBI Nucleotide NM_032404 (accessed on Feb. 27, 2007).
NCBI Nucleotide NM_032405 (accessed on Feb. 27, 2007).
NCBI Nucleotide NM_033011 (accessed on Feb. 27, 2007).
NCBI Nucleotide NM_033423 (accessed on Feb. 27, 2007).
NCBI Nucleotide NM_138563 (accessed on Feb. 27, 2007).
NCBI Nucleotide NM_138564 (accessed on Feb. 27, 2007).
NCBI Nucleotide NM_139277 (accessed on Feb. 27, 2007).
NCBI Nucleotide NM_144505 (accessed on Feb. 27, 2007).
NCBI Nucleotide NM_144506 (accessed on Feb. 27, 2007).
NCBI Nucleotide NM_144507 (accessed on Feb. 27, 2007).
NCBI Nucleotide NM_144947 (accessed on Feb. 27, 2007).
NCBI Nucleotide NM_144956 (accessed on Feb. 27, 2007).
NCBI Nucleotide NM_144957 (accessed on Feb. 27, 2007).
NCBI Nucleotide NM_145888 (accessed on Feb. 27, 2007).
NCBI Nucleotide NM_145894 (accessed on Feb. 27, 2007).
NCBI Nucleotide NM_145895 (accessed on Feb. 27, 2007).
NCBI Nucleotide NM_153609 (accessed on Feb. 27, 2007).
NCBI Nucleotide NM_182983 (accessed on Feb. 27, 2007).
NCBI Nucleotide NM_183062 (accessed on Feb. 27, 2007).
NCBI Nucleotide NM_183247 (accessed on Feb. 27, 2007).
NCBI Nucleotide NM_198464 (accessed on Feb. 27, 2007).
NCBI Protein AAA52380 (accessed Feb. 28, 2007).
NCBI Protein AAC80208 (accessed Feb. 28, 2007).
NCBI Protein AAD42765 (accessed Feb. 28, 2007).
NCBI Protein AAF04328 (accessed Feb. 28, 2007).
NCBI Protein AAH35384 (accessed Feb. 28, 2007).
NCBI Protein AAH41609 (accessed Feb. 28, 2007).
NCBI Protein AAH48112 (accessed Feb. 28, 2007).
NCBI Protein AAK61552 (accessed Feb. 28, 2007).
NCBI Protein AAK84071 (accessed Feb. 28, 2007).
NCBI Protein AAN04055 (accessed Feb. 28, 2007).
NCBI Protein BAB39741 (accessed Feb. 28, 2007).
NCBI Protein BAC11431 (accessed Feb. 28, 2007).
NCBI Protein CAC12709 (accessed Feb. 28, 2007).
NCBI Protein CAD66452 (accessed Feb. 28, 2007).
NCBI Protein CAD67579 (accessed Feb. 28, 2007).
NCBI Protein CAD67985 (accessed Feb. 28, 2007).
NCBI Protein NP_000119 (accessed Feb. 28, 2007).
NCBI Protein NP_000122 (accessed Feb. 28, 2007).
NCBI Protein NP_000124 (accessed Feb. 28, 2007).
NCBI Protein NP_000292 (accessed Feb. 28, 2007).
NCBI Protein NP_000303 (accessed Feb. 28, 2007).
NCBI Protein NP_000495 (accessed Feb. 28, 2007).
NCBI Protein NP_000496 (accessed Feb. 28, 2007).
NCBI Protein NP_000497 (accessed Feb. 28, 2007).
NCBI Protein NP_000883 (accessed Feb. 28, 2007).
NCBI Protein NP_000921 (accessed Feb. 28, 2007).
NCBI Protein NP_000922 (accessed Feb. 28, 2007).

NCBI Protein NP_001002231 (accessed Feb. 28, 2007).
NCBI Protein NP_001002232 (accessed Feb. 28, 2007).
NCBI Protein NP_001012982 (accessed Feb. 28, 2007).
NCBI Protein NP_001012983 (accessed Feb. 28, 2007).
NCBI Protein NP_001012984 (accessed Feb. 28, 2007).
NCBI Protein NP_001025218 (accessed Feb. 28, 2007).
NCBI Protein NP_001025219 (accessed Feb. 28, 2007).
NCBI Protein NP_001025220 (accessed Feb. 28, 2007).
NCBI Protein NP_001025221 (accessed Feb. 28, 2007).
NCBI Protein NP_001088 (accessed Feb. 28, 2007).
NCBI Protein NP_001519 (accessed Feb. 28, 2007).
NCBI Protein NP_001639 (accessed Feb. 28, 2007).
NCBI Protein NP_001827 (accessed Feb. 28, 2007).
NCBI Protein NP_001898 (accessed Feb. 28, 2007).
NCBI Protein NP_001902 (accessed Feb. 28, 2007).
NCBI Protein NP_001962 (accessed Feb. 28, 2007).
NCBI Protein NP_001963 (accessed Feb. 28, 2007).
NCBI Protein NP_002095 (accessed Feb. 28, 2007).
NCBI Protein NP_002142 (accessed Feb. 28, 2007).
NCBI Protein NP_002248 (accessed Feb. 28, 2007).
NCBI Protein NP_002649 (accessed Feb. 28, 2007).
NCBI Protein NP_002760 (accessed Feb. 28, 2007).
NCBI Protein NP_002761 (accessed Feb. 28, 2007).
NCBI Protein NP_002762 (accessed Feb. 28, 2007).
NCBI Protein NP_002763 (accessed Feb. 28, 2007).
NCBI Protein NP_002764 (accessed Feb. 28, 2007).
NCBI Protein NP_002765 (accessed Feb. 28, 2007).
NCBI Protein NP_002767 (accessed Feb. 28, 2007).
NCBI Protein NP_002768 (accessed Feb. 28, 2007).
NCBI Protein NP_003285 (accessed Feb. 28, 2007).
NCBI Protein NP_003610 (accessed Feb. 28, 2007).
NCBI Protein NP_004123 (accessed Feb. 28, 2007).
NCBI Protein NP_004253 (accessed Feb. 28, 2007).
NCBI Protein NP_004908 (accessed Feb. 28, 2007).
NCBI Protein NP_005037 (accessed Feb. 28, 2007).
NCBI Protein NP_005308 (accessed Feb. 28, 2007).
NCBI Protein NP_005542 (accessed Feb. 28, 2007).
NCBI Protein NP_005647 (accessed Feb. 28, 2007).
NCBI Protein NP_005738 (accessed Feb. 28, 2007).
NCBI Protein NP_006135 (accessed Feb. 28, 2007).
NCBI Protein NP_006578 (accessed Feb. 28, 2007).
NCBI Protein NP_006790 (accessed Feb. 28, 2007).
NCBI Protein NP_006844 (accessed Feb. 28, 2007).
NCBI Protein NP_009104 (accessed Feb. 28, 2007).
NCBI Protein NP_009127 (accessed Feb. 28, 2007).
NCBI Protein NP_009203 (accessed Feb. 28, 2007).
NCBI Protein NP_031378 (accessed Feb. 28, 2007).
NCBI Protein NP_036447 (accessed Feb. 28, 2007).
NCBI Protein NP_036559 (accessed Feb. 28, 2007).
NCBI Protein NP_056411 (accessed Feb. 28, 2007).
NCBI Protein NP_056933 (accessed Feb. 28, 2007).
NCBI Protein NP_059979 (accessed Feb. 28, 2007).
NCBI Protein NP_062505 (accessed Feb. 28, 2007).
NCBI Protein NP_062544 (accessed Feb. 28, 2007).
NCBI Protein NP_062562 (accessed Feb. 28, 2007).
NCBI Protein NP_063947 (accessed Feb. 28, 2007).
NCBI Protein NP_071402 (accessed Feb. 28, 2007).
NCBI Protein NP_075382 (accessed Feb. 28, 2007).
NCBI Protein NP_076927 (accessed Feb. 28, 2007).
NCBI Protein NP_077078 (accessed Feb. 28, 2007).
NCBI Protein NP_110397 (accessed Feb. 28, 2007).
NCBI Protein NP_114154 (accessed Feb. 28, 2007).
NCBI Protein NP_115777 (accessed Feb. 28, 2007).
NCBI Protein NP_115780 (accessed Feb. 28, 2007).
NCBI Protein NP_115781 (accessed Feb. 28, 2007).
NCBI Protein NP_127509 (accessed Feb. 28, 2007).
NCBI Protein NP_219491 (accessed Feb. 28, 2007).
NCBI Protein NP_612630 (accessed Feb. 28, 2007).
NCBI Protein NP_612631 (accessed Feb. 28, 2007).
NCBI Protein NP_644806 (accessed Feb. 28, 2007).
NCBI Protein NP_653088 (accessed Feb. 28, 2007).
NCBI Protein NP_653089 (accessed Feb. 28, 2007).
NCBI Protein NP_653090 (accessed Feb. 28, 2007).
NCBI Protein NP_659196 (accessed Feb. 28, 2007).
NCBI Protein NP_659205 (accessed Feb. 28, 2007).
NCBI Protein NP_659206 (accessed Feb. 28, 2007).
NCBI Protein NP_665895 (accessed Feb. 28, 2007).
NCBI Protein NP_665901 (accessed Feb. 28, 2007).
NCBI Protein NP_665902 (accessed Feb. 28, 2007).
NCBI Protein NP_705837 (accessed Feb. 28, 2007).
NCBI Protein NP_892028 (accessed Feb. 28, 2007).
NCBI Protein NP_898885 (accessed Feb. 28, 2007).
NCBI Protein NP_899070 (accessed Feb. 28, 2007).
NCBI Protein NP_940866 (accessed Feb. 28, 2007).
NCBI Protein O01382 (accessed Feb. 28, 2007).
NCBI Protein O02002 (accessed Feb. 28, 2007).
NCBI Protein O08736 (accessed Feb. 28, 2007).
NCBI Protein O15519 (accessed Feb. 28, 2007).
NCBI Protein O60911 (accessed Feb. 28, 2007).
NCBI Protein O75601 (accessed Feb. 28, 2007).
NCBI Protein P00749 (accessed Feb. 28, 2007).
NCBI Protein P00780 (accessed Feb. 28, 2007).
NCBI Protein P00781 (accessed Feb. 28, 2007).
NCBI Protein P00784 (accessed Feb. 28, 2007).
NCBI Protein P04072 (accessed Feb. 28, 2007).
NCBI Protein P04189 (accessed Feb. 28, 2007).
NCBI Protein P06873 (accessed Feb. 28, 2007).
NCBI Protein P07518 (accessed Feb. 28, 2007).
NCBI Protein P07711 (accessed Feb. 28, 2007).
NCBI Protein P07858 (accessed Feb. 28, 2007).
NCBI Protein P09489 (accessed Feb. 28, 2007).
NCBI Protein P09958 (accessed Feb. 28, 2007).
NCBI Protein P10144 (accessed Feb. 28, 2007).
NCBI Protein P13134 (accessed Feb. 28, 2007).
NCBI Protein P15292 (accessed Feb. 28, 2007).
NCBI Protein P15926 (accessed Feb. 28, 2007).
NCBI Protein P16588 (accessed Feb. 28, 2007).
NCBI Protein P17538 (accessed Feb. 28, 2007).
NCBI Protein P23916 (accessed Feb. 28, 2007).
NCBI Protein P25774 (accessed Feb. 28, 2007).
NCBI Protein P25779 (accessed Feb. 28, 2007).
NCBI Protein P29122 (accessed Feb. 28, 2007).
NCBI Protein P29141 (accessed Feb. 28, 2007).
NCBI Protein P29142 (accessed Feb. 28, 2007).
NCBI Protein P29594 (accessed Feb. 28, 2007).
NCBI Protein P29600 (accessed Feb. 28, 2007).
NCBI Protein P30199 (accessed Feb. 28, 2007).
NCBI Protein P30430 (accessed Feb. 28, 2007).
NCBI Protein P31944 (accessed Feb. 28, 2007).
NCBI Protein P34168 (accessed Feb. 28, 2007).
NCBI Protein P42573 (accessed Feb. 28, 2007).
NCBI Protein P42574 (accessed Feb. 28, 2007).
NCBI Protein P43235 (accessed Feb. 28, 2007).
NCBI Protein P43527 (accessed Feb. 28, 2007).
NCBI Protein P49662 (accessed Feb. 28, 2007).
NCBI Protein P51878 (accessed Feb. 28, 2007).
NCBI Protein P55210 (accessed Feb. 28, 2007).
NCBI Protein P55211 (accessed Feb. 28, 2007).
NCBI Protein P55212 (accessed Feb. 28, 2007).
NCBI Protein P70343 (accessed Feb. 28, 2007).
NCBI Protein Q03420 (accessed Feb. 28, 2007).
NCBI Protein Q14790 (accessed Feb. 28, 2007).
NCBI Protein Q45670 (accessed Feb. 28, 2007).
NCBI Protein Q92851 (accessed Feb. 28, 2007).
NCBI Protein Q9BZJ3 (accessed Feb. 28, 2007).
NCBI Protein Q9P0G3 (accessed Feb. 28, 2007).
NCBI Protein Q9UBX1 (accessed Feb. 28, 2007).
NCBI Protein Q9UDY8 (accessed Feb. 28, 2007).
NCBI Protein Q9V6K1 (accessed Feb. 28, 2007).
NCBI Protein Q9XYF4 (accessed Feb. 28, 2007).
NCBI Protein Q9Z2A8 (accessed Feb. 28, 2007).
Armstrong et al., "Vectors for Phage Display," in: Phage Display of Peptides and Proteins: A Laboratory Manual, Kay, Winger and MCCafferty (eds.), Academic Press, New York, pp. 35-53 (1996).
Bass et al., "Cellular mechanisms regulating non-haemostatic plasmin generation," Biochem. Soc. Trans. 30:189-194 (2002).

Bode et al., "Tissue-type plasminogen activator: variants and crystal/solution structures demarcate structural determinants of function," Curr. Opin. Struc. Biol. 7:865-872 (1997).

Chang et al., "Nucleotide sequence of the alkaline phosphatase gene of *Escherichia coli*," Gene 44:121-125 (1986).

Choi, J. and S. Lee, "Secretory and extracellular production of recombinant proteins using *Escherichia coli*," Appl. Microbiol. Biotechnol. 64:625-635 (2004).

De Taeye et al., "Immobilization of the distal hinge in the labile serpin plasminogen activator inhibitor 1," J. Biol. Chem. 278(26):23899-23905 (2003).

Gupta, Y. and S. Briyal, "Animal models of cerebral ischemia for evaluation of drugs," Indian J. Physiol. Pharmacol. 48:379-394 (2004).

Herrera-Estrella et al., "Expression of chimaeric genes transferred into plant cells using a ti-plasmid-derived vector," Nature 303:209-213 (1984).

Legendre et al., "Display of active subtilisin 309 on phage: analysis of parameters influencing the selection of subtilisin variants with changed substrate specificity from libraries using phosphonylating inhibitors," J. Mol. Biol. 296(1):87-102 (2000).

Written Opinion, issued Sep. 23, 2010, in connection with Singapore Patent Application No. 200900494-6 (10 pages).

Olsen et al., "Function-based isolation of novel enzymes from a large library," Nat. Biotechnol. 18:1071-1074 (2000).

Plotnick et al., "Heterogeneity in serpin-protease complexes as demonstrated by differences in the mechanism of complex breakdown," Biochem. 41:334-342 (2002).

Official Action, issued Feb. 13, 2011, in connection with corresponding Israeli Patent Application No. 196314, 10 pages.

Response to Written Opinion, submitted Feb. 23, 2011, in connection with corresponding Singapore Patent Application No. 200900494-6, 4 pages.

Official Action and Search Report, issued Apr. 11, 2011, in connection with corresponding Taiwanese Patent Application No. 96124475, 3 pages.

Response to Examiner's Report, submitted Apr. 28, 2011, in connection with corresponding Canadian Patent Application No. 2,656,531, 18 pages.

Examiner's Report, issued May 19, 2011, in connection with corresponding Canadian Patent Application No. 2,656,531, 4 pages.

Response to Official Action, submitted May 24, 2011, in connection with corresponding Chinese Patent Application No. 200780032858.4, 36 pages.

Official Action, issued Jun. 7, 2011, in connection with corresponding Japanese Patent Application No. 2009-518386, 7 pages.

Response to Official Action, submitted Jun. 12, 2011, in connection with corresponding Israeli Patent Application No. 196314, 2 pages.

Examination Report, issued Sep. 26, 2011, in connection with corresponding Canadian Patent Application No. 2,656,531, 4 pages.

Examination Report, issued Oct. 13, 2011, in connection with corresponding Taiwanese Patent Application No. 096124475, 7 pages.

Examination Report, issued Nov. 23, 2011, in connection with corresponding New Zealand Patent Application No. 574140, 1 page.

International Preliminary Report on Patentability, issued Dec. 22, 2008, in connection with corresponding International PCT Application No. PCT/US2007/015571.

Office Action, issued Jun. 29, 2009, in connection with Japanese Patent Application No. 2009-518386.

Examination Report, issued Jul. 3, 2009, in connection with European Patent Application No. 07861330.4.

Search Report and Written Opinion, issued Aug. 27, 2009, in connection with Singapore Patent Application No. 200900494-6.

Examination Report, issued Dec. 29, 2009, in connection with Canadian Patent Application No. 2656531.

International Search Report and Written Opinion, issued Jul. 23, 2008, in connection with corresponding International PCT Application No. PCT/US2007/015571.

Partial International Search Report, issued May 6, 2008, in connection with corresponding International PCT Application No. PCT/US2007/015571.

Office Action (English translation), issued Feb. 16, 2010, in connection with Japanese Patent Application Serial No. 2009-518386.

Office Action (English translation), issued Feb. 16, 2010, in connection with Japanese Patent Application Serial No. 2009-292841.

Examination Report, issued Mar. 2, 2010, in connection with European Patent Application Serial No. 07 861 330.4.

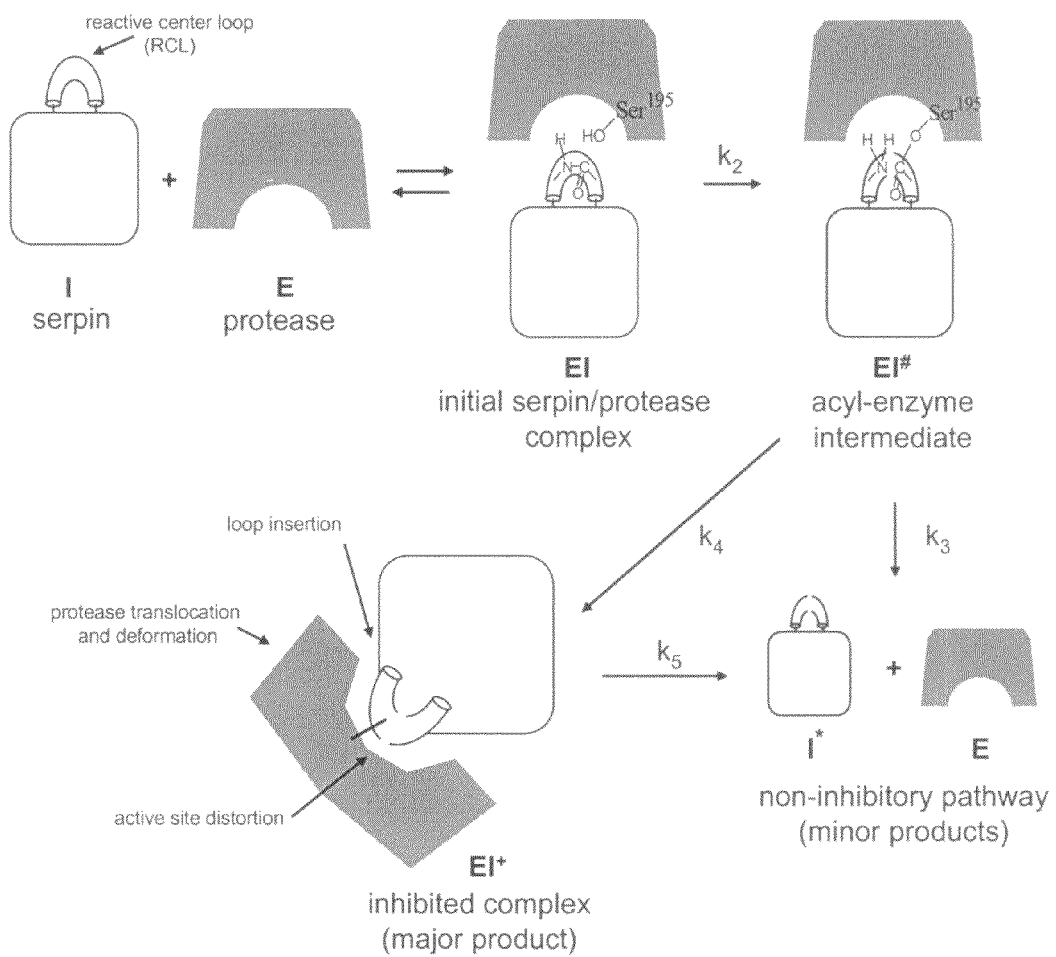

PROTEASE SCREENING METHODS AND PROTEASES IDENTIFIED THEREBY

RELATED APPLICATIONS

Benefit of priority is claimed to U.S. Provisional Application Ser. No. 60/818,804, to Edwin Madison, entitled "Protease Screening Methods and Proteases Identified Thereby," filed Jul. 5, 2006, and to U.S. Provisional Application Ser. No. 60/818,910, to Edwin Madison, entitled "Modified Urinary-Plasminogen Activator (u-PA) Proteases," filed Jul. 5, 2006. The subject matter of the above-noted applications is incorporated by reference in its entirety.

This application is related to International Application No. PCT/US2007/015571 to Edwin Madison, entitled "Protease Screening Methods and Proteases Identified Thereby," filed Jul. 5, 2007, which also claims priority to U.S. Provisional Application Ser. No. 60/818,804 and to U.S. Provisional Application Ser. No. 60/818,910.

This application also is related to U.S. application Ser. No. 10/677,977, filed Oct. 2, 2003 and published as U.S. Application No. US-2004-0146938 on Jul. 29, 2004, entitled "Methods of Generating and Screening for Proteases with Altered Specificity" to J Nguyen, C Thanos, S Waugh-Ruggles, and C Craik, and to corresponding published International PCT Application No. WO2004/031733, published Apr. 15, 2004, which claim benefit to U.S. Provisional Application Ser. No. 60/415,388 filed Oct. 2, 2002.

This application also is related to U.S. application Ser. No. 11/104,110, filed Apr. 12, 2005 and published as U.S. Application No. US-2006-0002916 on Jan. 5, 2006, entitled "Cleavage of VEGF and VEGF Receptor by Wild-Type and Mutant MTSP-1" to J Nguyen and S Waugh-Ruggles, and to corresponding published International PCT Application No. WO2005/110453, published Nov. 24, 2005, which claim benefit to U.S. Provisional Application Ser. No. 60/561,720 filed Apr. 12, 2004.

This application also is related to U.S. application Ser. No. 11/104,111, filed Apr. 12, 2005 and published as U.S. Application No. US-2006-0024289 on Feb. 2, 2006, entitled "Cleavage of VEGF and VEGF Receptor by Wild-Type and Mutant Proteases" to J Nguyen and S Waugh-Ruggles, and to corresponding published International PCT Application No. WO2005/100556, published Oct. 27, 2005, which claim benefit to U.S. Provisional Application Ser. No. 60/561,671 filed Apr. 12, 2004.

This application also is related to U.S. Provisional Application Ser. No. 60/729,817 filed Oct. 21, 2005, entitled "Modified Proteases that Inhibit Complement Activation" to Edwin L. Madison. This application also is related to U.S. application Ser. No. 11/584,776 filed Oct. 20, 2006, entitled "Modified Proteases that Inhibit Complement Activation" to Edwin L. Madison, Jack Nguyen, Sandra Waugh Ruggles and Christopher Thanos, and to corresponding published International PCT Application No. WO2007/047995, published Apr. 26, 2007, which each claim benefit to U.S. Provisional Application No. 60/729,817.

The subject matter of each of the above-noted related applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy # 1 and Copy # 2), the contents of which are incorporated by reference in their entirety. The computer-readable file on each of the aforementioned compact discs, created on Jul. 5, 2007, is identical, 1,809 kilobytes in size, and titled 4902SEQ.001.txt. A substitute Sequence Listing, incorporated by reference in its entirety, is provided on identical compact discs (labeled Copy #1 Replacement, Copy #2 Replacement and Computer-Readable Form Replacement), each compact disc containing the file 4902SEQ.003.txt, created on Oct. 27, 2010, 1.76 megabytes in size.

FIELD OF THE INVENTION

Methods for identifying modified proteases with modified substrate specificity or other properties are provided. The methods screen candidate and modified proteases by contacting them with a substrate that traps them upon cleavage of the substrate.

BACKGROUND

Proteases are protein-degrading enzymes. Because proteases can specifically interact with and inactivate or activate a target protein, they have been employed as therapeutics. Naturally-occurring proteases often are not optimal therapeutics since they do not exhibit the specificity, stability and/or catalytic activity that renders them suitable as biotherapeutics (see, e.g., Fernandez-Gacio et al. (2003) *Trends in Biotech.* 21: 408-414). Among properties of therapeutics that are important are lack of immunogenicity or reduced immunogenicity; specificity for a target molecule, and limited side-effects. Naturally-occurring proteases generally are deficient in one or more of these properties.

Attempts have been made to engineer proteases with improved properties. Among these approaches include 1) rational design, which requires information about the structure, catalytic mechanisms, and molecular modeling of a protease; and 2) directed evolution, which is a process that involves the generation of a diverse mutant repertoire for a protease, and selection of those mutants that exhibit a desired characteristic (Bertschinger et al. (2005) in *Phage display in Biotech. and Drug Discovery* (Sidhu s, ed), pp. 461-491). For the former approach, a lack of information regarding the structure-function relationship of proteases limits the ability to rationally design mutations for most proteases. Directed evolution methodologies have been employed with limited success.

Screening for improved protease activity often leads to a loss of substrate selectivity and vice versa. An optimal therapeutic protease should exhibit a high specificity for a target substrate and a high catalytic efficiency. Because of the limited effectiveness of available methods to select for proteases with optimized specificity and optimized activity, there remains a need to develop alternate methods of protease selection. Accordingly, it is among the objects herein to provide methods for selection of proteases or mutant proteases with desired substrate specificities and activities.

SUMMARY

Provided are methods for selection or identification of proteases or mutant proteases or catalytically active portions thereof with desired or predetermined substrate specificities and activities. In particular, provided herein are protease screening methods that identify proteases that have an altered, improved, or optimized or otherwise altered substrate specificity and/or activity for a target substrate or substrates. The methods can be used, for example, to screen for proteases that have an altered substrate specificity and/or activity for a target substrate involved in the etiology of a disease or disorder. By virtue of the altered, typically increased, specificity and/or activity for a target substrate, the proteases identified or selected in the methods provided herein are candidates for use as reagents or therapeutics in the treatment of diseases or conditions for which the target substrate is involved. In practicing the methods provided herein, a collection of proteases or catalytically active portion thereof is contacted with a protease trap polypeptide resulting in the formation of stable complexes of the protease trap polypeptide with proteases or catalytically active portion thereof in the collection. In some examples, the protease trap polypeptide is modified to be cleaved by a protease having a predetermined substrate specificity and/or activity for a target substrate, for example, a target substrate involved in a disease or disorder. The method can further comprise screening the complexes for substrate specificity for the cleavage sequence of the target substrate. In such examples, the identified or selected protease has an altered activity and/or specificity towards the target substrate. In one example, the stable complex is formed by covalent linkage of a selected protease with a protease trap polypeptide. The selected proteases or catalytically active portion thereof are identified or selected from the complex in the methods provided herein. The methods provided herein can further include the step of separating the complexed proteases from the uncomplexed protease members of the collection. In one example, the protease trap polypeptide is labeled for detection or separation and separation is effected by capture of complexes containing the detectable protease trap polypeptide and the protease or catalytically active portion thereof. Capture can be effected in suspension, solution or on a solid support. In instances where capture is by a solid support, the protease trap polypeptide is attached to the solid support, which can be effected before, during or subsequent to contact of the protease trap polypeptide with the collection of proteases or catalytically active portions thereof. The solid support can include, for example, a well of a 96-well plate. In some examples, the protease trap polypeptide is labeled with biotin. In other examples, the protease trap polypeptide can be labeled with a His tag and separation can be effected by capture with a metal chelating agent such as, but not limited to, nickel sulphate ($NiSO_4$), cobalt chloride ($CoCl_2$), copper sulphate ($CuSO_4$) and zinc chloride ($ZnCl_2$). The metal chelating agent can be conjugated to a solid support, such as for example, on beads such as sepharose beads or magnetic beads.

In the methods provided herein, the method can further include a step of amplifying the protease or catalytically active portion thereof in the separated complexes. In some examples, the protease or catalytically active portion thereof in the separated complex is displayed on a phage, and amplification is effected by infecting a host cell with the phage. The host cells can include a bacteria, for example, E. coli. The amplified protease, either from bacterial cell medium, bacterial periplasm, phage supernatant or purified protein, can be screened for specificity and/or activity towards a target substrate. Typically, the target substrate is a polypeptide or cleavage sequence in a polypeptide involved in the etiology of a disease or disorder.

Also provided herein is a multiplexing method whereby the collection of proteases are contacted with a plurality of different protease trap polypeptides, including modified forms thereof, where each of the protease trap polypeptides are labeled such that they can be identifiably detected. In such methods, at least two protease trap polypeptides are identifiable labeled such that more than one stable complex can form and more than one protease is identified.

In the methods provided herein, the methods also include successive rounds of screening to optimize protease selection where proteases are amplified following their identification or selection in a first round of the screening methods herein, to thereby produce a second collection of proteases or catalytically active portions thereof. The second collection of proteases are contacted with a protease trap polypeptide, that is the same or different than the first protease trap polypeptide, to produce a second set of stable complexes. The proteases in the second set of stable complexes are identified or selected.

In the methods provided herein, the protease trap polypeptide is a serpin, a member of the alpha macroglobulin family, or a member of the p35 family. Such a polypeptide molecule used in the methods provided herein forms a stable complex by covalent linkage of a protease or catalytically active portion thereof with the protease trap polypeptide.

In one aspect of the method provided herein, proteases are identified that have a desired substrate specificity by contacting a collection of protease and/or proteolytically active portions of proteases with a protease trap polypeptide to form stable complexes of the protease trap polypeptide with a protease upon cleavage of the protease trap polypeptide. The protease trap polypeptide, or modified form thereof, is selected for use in the methods for purposes of being cleaved by a protease having the desired substrate specificity. In the methods, the protease or proteolytically active portion thereof is identified to select for a protease having a desired substrate specificity.

The collection of proteases used in the methods provided herein are any collection of proteases or catalytically active portions thereof and include members with at least, about, or equal to 5, 10, 50, 100, $10^3$, $10^4$, $10^5$, $10^6$ or more different members. In some aspects, the proteases are serine and/or cysteine proteases. In the methods provided herein, the collection of proteases or catalytically active portions thereof are displayed for contact with a protease trap polypeptide. In one example, the protease or proteolytically active portion thereof are displayed on a solid support, cell surface, or on a surface of a microorganism. The protease can be displayed on yeast, bacterium, a virus, a phage, a nucleic acid, an mRNA molecule, or on ribosomes. Where the protease or proteolytically active portion thereof is displayed on a microorganism the microorganism includes, but is not limited to, E. coli, S. cerevisiae, or a virus such as an M13, fd, or T7 phage, or a baculovirus. In the methods provided herein, the proteases or proteolytically active portions thereof are displayed on a phage display library and the protease collection is a protease phage display library. In some embodiments, the proteases are provided in the collections, such as by display, as proteolytically active portions of a full-length protease. In some examples, contact of a protease collection with a protease trap polypeptide is in a homogenous mixture.

Provided herein is a method of protease selection where at least two different protease trap polypeptides are contacted with the collection, but where only one of the protease trap polypeptides is detectably labeled. The protease trap polypeptide that is detectably labeled permits the capture of stable complexes containing the detectable protease trap polypeptide and a protease or catalytically active portion thereof. In some examples of this method, the one or more other protease trap polypeptides that are not detectably labeled are present in excess in the reaction compared to the detectably labeled protease trap polypeptide. In the methods, the label is any label for detection thereof, such as a fluorescent label or an epitope label such as a His tag. In other examples, the detectable label is biotin.

The collection of proteases for which selection is made in the methods provided herein include any collection of proteases. In some examples, the proteases are serine or cysteine proteases. The collection of proteases include those that are members of the chymotrypsin and subtilisin family of serine proteases or from the caspases of the papain family of cysteine proteases. The proteases include any proteases, or catalytically active portion thereof, set forth in Table 7. In some examples, the protease or catalytically active portion thereof are collections of urokinase plasminogen activator (u-PA) proteases, tissue plasminogen activator (t-PA) proteases, or MT-SP1 proteases.

In one aspect, the protease trap polypeptides used in the methods provided herein are serpins, p35 family members, alpha-macroglobulin family members, or any modified forms thereof. A protease trap polypeptide used in the methods provided herein include, but is not limited to, plasminogen inhibitor-1 (PAI-1), antithrombin (AT3), or alpha 2-macroglobulin, or modified forms thereof. Modified forms of a protease trap polypeptide used in the methods provided herein included those containing amino acid replacement, deletions, or substitutions in the reactive site of the protease trap polypeptide. In some examples, the modification is any one or more amino acid replacements corresponding to a cleavage sequence of a target substrate. The target substrate can be any protein involved in an etiology of a disease or disorder. Examples of target substrates include, but are not limited to, a VEGFR, a t-PA cleavage sequence, or a complement protein. For example, target substrates include, but are not limited to, VEGFR2 or complement protein C2. The cleavage sequence of a target substrate includes, but is not limited to, any set forth in any of SEQ ID NOS: 389, 479 and 498. In some aspects, the protease trap polypeptide is a serpin and the one or more amino acid replacements is/are in the reactive site loop of the serpin polypeptide. The one or more replacements in the reactive site loop (RSL) include those in any one or more of the P4-P2' positions. Exemplary of such serpins used in the methods provided herein are any set forth in any of SEQ ID NOS: 497, 499, 610 and 611. In another example, the protease trap polypeptide is an alpha 2 macroglobulin and the one or more amino acid replacements are in the bait region of the polypeptide. The proteases identified or selected in the methods herein against a modified protease trap polypeptide can be screened or selected for altered substrate specificity for the target substrate as compared to a non-target substrate. In such examples, the non-target substrate includes a substrate of the corresponding template protease. Typically, the substrate specificity of the identified or selected protease is increased by 1.5-fold, 2-fold, 5-fold, 10-fold, 50-fold, 100-fold, 200-fold, 300-fold, 400-fold, 500-fold or more.

The methods provided herein include those that are iterative where the method of identifying and/or selecting for proteases with a desired substrate specificity is repeated or performed a plurality of times. In such methods, a plurality of different proteases can be identified in the first iteration, or the first round, of the method. In other examples, a plurality of proteases are generated and prepared after the first iteration based on the identified proteases selected in the first round of iteration. Additionally, in some examples, the amino acid sequences of selected proteases identified in the first round or iteration and/or in successive rounds are compared to identify hot spots. Hot spots are those positions that are recognized as a modified locus in multiple rounds, such as occur in at least 2, 3, 4, 5 or more identified proteases, such as compared to a wild-type or template protease, from a collection of modified proteases used in the method.

Also provided in the method herein is a further step of, after identifying a protease or proteases, preparing a second collection of proteases, where an identified protease is used a template to make further mutations in the protease sequence or catalytically active portion thereof such that members of the second collection (are based on) contain polypeptides having mutations of the identified proteases and additional mutations; then contacting the second collection with a protease trap polypeptide that is either identical or different from the protease trap used to isolate the first protease or proteases, where the protease trap is modified to be cleaved by a protease having the desired substrate specificity; and identifying a protease(s) or proteolytically active portion(s) of a protease from the collection in a complex, whereby the identified protease(s) has greater activity or specificity towards the desired substrate than the first identified protease. The second collection can contain random or focused mutations compared to the sequence of amino acids of the identified template protease(s) or proteolytically active portion of a protease. Focused mutations, include, for example, hot spot positions, such as positions 30, 73, 89 and 155, based on chymotrypsin numbering, in a serine protease, such as u-PA.

In practicing the methods, the reaction for forming stable complexes can be modulated by controlling one or more parameters. Such parameters are any that alter the rate or extent of reaction or efficiency of the reaction, such as, but are not limited to, reaction time, temperature, pH, ionic strength, library concentration and protease trap polypeptide concentration.

The reactions can be performed in the presence of a competitor of the reaction between a protease trap polypeptide and a protease or proteolytically active portion thereof to thereby enhance selectivity of identified protease(s) or proteolytically active portion(s). Competitors include, for example, serum or plasma. Such as human serum or human plasma, a cell or tissue extract, a biological fluid, such as urine or blood, a purified or partially purified wild type form (or other modified form) of the protease trap. Exemplary of such competitors is a purified or partially purified wild-type form of a protease trap polypeptide or one or more specific variants of a protease trap polypeptide.

Iterative methods for evolving or selecting or identifying a protease or proteolytically active portion thereof with specificity/selectivity and/or activity for at least two cleavage sequences are provided. The methods include the steps of: a) contacting a collection of proteases and/or proteolytically active portions of proteases with a first protease trap polypeptide to form, upon cleavage of the protease trap polypeptide by the protease or proteolytically active portion thereof, stable complexes containing the protease trap polypeptide with a protease or catalytically active portion thereof in the collection, wherein contacting is effected in the presence of a competitor; b) identifying or selecting proteases or proteolytically active portions thereof that form complexes with the first protease trap polypeptide; c) contacting proteases or proteolytically active portion thereof that form complexes with the first protease trap polypeptide with a second protease trap polypeptide in the presence of a competitor; and d) identifying or selecting proteases or proteolytically active portions thereof that form complexes with the first protease trap polypeptide. The two cleavage sequences can be in one target substrate or can be in two different target substrates. The identified, selected or evolved protease or proteolytically active portion thereof has substrate specificity and/or cleavage activity for at least two different cleavage sequences in one or two different target substrates. The first and second protease trap polypeptide can be the same or different. Typically, the first and second protease trap polypeptide used in the method are different and each are modified to be cleaved by a protease having the predetermined substrate specificity for different target substrates. The method can further include repeating steps a) and b) or a)-d) at least once more until a protease with a desired or predetermined substrate specificity and cleavage activity to at least two recognition sequences is isolated. Substrate specificity and cleavage activity typically are increased compared with a template protease.

Competitors for use in the methods include anything with which the protease trap polypeptide can interact, typically with lesser stability than a target protease. Competitors include, but are not limited to, serum, plasma, human serum or human plasma, a cell or tissue extract, a biological fluid such as urine or blood, a purified or partially purified wild-type form of the protease trap, and one or more specific variants of a protease trap polypeptide.

Also provided are methods of protease selection that include the steps of: a) contacting a collection of proteases or proteolytically active portions thereof with a first protease trap polypeptide to form, upon cleavage of the protease trap polypeptide, covalent complexes of the protease trap polypeptide with any protease or catalytically active portion thereof in the collection; b) separating the complexed proteases from uncomplexed protease trap polypeptide(s); c) isolating or selecting or identifying the complexed proteases; d) generating a second collection of proteases or proteolytically active portions of proteases based on the selected proteases; and e) repeating steps a)-c) by contacting the second collection of proteases or proteolytically active portions thereof with a second protease trap polypeptide that is different from the first protease trap polypeptide to form complexes; separating the complexes; and isolating, selecting or identifying complexed proteases. The first and second protease trap polypeptides can be modified to contain two different target substrate recognition sequences, whereby the identified or selected protease has specificity and high cleavage activity to at least two recognition sequences. These methods can be repeated a plurality of times. In these methods, the collection of proteases or proteolytically active portions thereof can be contacted with the first and/or second protease trap polypeptide in the presence of a competitor (see above).

In any of the methods of protease selection provided herein, the collections can contain modified proteases. The modifications in the proteases can be random or focused or in a target region of the polypeptide.

Also provided are combinations that contain a collection of proteases and/or proteolytically active portions thereof; and at least one protease trap polypeptide. The components can be provided separately or as a mixture. The protease trap polypeptide include, among serpins, p35 family members, alpha-macroglobulin family members, modified forms of each, and mixtures thereof.

The collection of proteases and/or catalytically active portions thereof can be provided in solution or suspension or in a solid phase or otherwise displayed, such as on a solid support (matrix material) or in a display library, such as, but not limited to, a phage display library, where members display at least a proteolytically active portion of a protease.

Kits containing the combinations are provided. Typically the kits contain the packaged components and, optionally, additional reagents and instructions for performing the methods.

Also provided are methods for modifying the substrate specificity of a serine protease, such as u-PA, by modifying one or more of residues selected from 30, 73, 89 and 155 based on chymotrypsin numbering.

Also provided are modified proteases identified by the methods herein. The modified proteases provided herein exhibit altered substrate specificity and/or activity by virtue of the identified modification. Any of the modifications provided herein identified using the selection method can be made in a wild-type protease, any allelic or species variant thereof, or in any other variant of the protease. In addition, also provided herein are modified proteases containing 80%, 85%, 90%, 91%, 92%, 93%, 94%, 95%, 96%, 97%, 98%, 99% or more sequence identity to a wild-type protease, or allelic or species variant thereof, so long as the modification identified in the methods herein is present.

Among such proteases are modified proteases, including modified serine proteases in the chymotrypsin family, such as urinary plasminogen activator (u-PA) polypeptides, or catalytically active fragments thereof containing one or more mutations in hot spot positions selected from among positions 30, 73, 89, and 155, based on chymotrypsin numbering, whereby substrate specificity is altered.

Provided herein also include modified urinary plasminogen activator (u-PA) proteases identified in the method herein that exhibit increased specificity and/or activity towards a target substrate involved in the etiology of a disease or disorder. Such target substrates include, but are not limited to, a VEGFR or a tissue plasminogen activator (t-PA) substrate. Hence, also provided are modified serine proteases or catalytically active portions thereof that cleave a t-PA substrate. In particular, among such proteases are modified urinary plasminogen activator (u-PA) polypeptides in which the u-PA polypeptide or catalytically active portion thereof contains one or more modifications in positions selected from among positions 21, 24, 30, 39, 61(A), 80, 82, 84, 89, 92, 156, 158, 159, and 187, based on chymotrypsin numbering. Also provided are such modified u-PA polypeptides or catalytically active portions thereof containing one or more mutations selected from among F21V, I24L, F30V, F30L, T39A, Y61(A)H, E80G, K82E, E84K, I89V, K92E, K156T, T158A, V159A, and K187E. Also provided are these modified u-PA polypeptides where the u-PA polypeptide or catalytically active portions thereof contain two or more mutations selected from among F30V/Y61(a)H; F30V/K82E; F30V/K156T; F30V/K82E/V159A; F30V/K82E/T39A/V159A; F30V/K82E/T158A/V159A; F30V/Y61 (a)H/K92E; F30V/K82E/V159A/E80G/I89V/K187E; and F30V/K82E/V159A/E80G/E84K/I89V\K187E.

Also provided are modified serine proteases or catalytically active portions thereof that cleave VEGFR, particularly VEGFR-2. In particular, provided are modified urinary plasminogen activator (u-PA) polypeptides and catalytically active portions thereof, wherein the u-PA polypeptide or catalytically active portion thereof contains one or more modifications in positions selected from among positions 38, 72, 73, 75, 132, 133, 137, 138, 155, 160, and 217, based on chymotrypsin numbering, whereby substrate specificity to a VEGFR-2, or sequence thereof, is altered. Also provided are such polypeptides that contain one or more mutations selected from among V38D, R72G, L73A, L73P, S75P, F132L, G133D, E137G, I138T, L155P, L155V, L155M, V160A, and R217C. These polypeptides can further include a modification at position 30 and/or position 89, based on chymotrypsin numbering, such as modifications selected from among F30I, F30T, F30L, F30V, F30G, F30M, and I89V. Also provided are these u-PA polypeptides or catalytically active portions thereof that contain one or more mutations, and in some instances two or more mutations selected from among L73A/I89V; L73P; R217C; L155P; S75P/I89V/I138T; E137G; R72G/L155P; G133D; V160A; V38D; F132L/V160A; L73A/I89V/F30T; L73A/I89V/F30L; L73A/I89V/F30V; L73A/I89V/F30G; L73A/I89V/L 155V; L73A/I89V/F30M; L73A/I89V/L 155M; L73A/I89V/F30L/L155M; and L73A/I89V/F30G/L155M.

Also provided are modified u-PA polypeptide, wherein the u-PA polypeptide or catalytically active portion thereof contains one or more mutations selected from among F30I, F30T, F30G, and F30M.

Also provided herein are modified MT-SP 1 polypeptides identified by the methods herein. Such modified polypeptides include any having one or more amino acid modifications selected from among D23E, I41F, I41T, L52M, Y60(g)s, T65K, H71R, F93L, N95K, F97Y, F97L, T98P, F99L, A126T, V129D, P131S, I136T, I136V, H143R, T144I, I154V, N164D, T166A, L171F, P173S, F184(a)L, Q192H, S201I, Q209L, Q221(a)L, R230W, F234L, and V244G, based on chymotrypsin numbering, in an MT-SP1 polypeptide set forth in SEQ ID NO:253. In some examples, the modifications are in a catalytically active portion of an MT-SP1 having a sequence of amino acids set forth in SEQ ID NO:505. In other examples, the modifications are in an MT-SP 1 polypeptide further comprising a modification corresponding to modification of C122S in an MT-SP 1 polypeptide set forth in SEQ ID NO:253, based on chymotrypsin numbering, for example, an MT-SP1 set forth in SEQ ID NO: 507 or 517. In particular of modifications provided herein are any selected from among I41F, F97Y, L171F and V244G. The modified MT-SP1 polypeptides provided herein can further include one or more modifications corresponding to Q175R or D217V in an MT-SP1 polypeptide set forth in SEQ ID NO:253. Such modifications include any selected from among I136T/N164D/T166A/F184(A)L/D217V;  I41F;  I41F/A126T/V244G;  D23E/I41F/T98P /T144I;  I41F/L171F/V244G; H143R/Q175R; I41F/L171F; R230W; I41F/I154V/V244G; I41F/L52M/V129D/Q221(A)L;  F99L;  F97Y/I136V/Q192H/S201I; H71R/ P131S/D217V; D217V; T65K/F93L/F97Y/D217V; I41T/P173S/Q209L; F97L/F234L; Q175R; N95K; and Y60(G)S. Any of the above modified MT-SP1 polypeptides exhibit modifications that increase one or both of specificity for a C2 complement protein or activity towards C2 complement protein.

Also provided are pharmaceutical compositions containing the modified proteases, including modified serine proteases, such as the modified u-PA polypeptides or modified MT-SP1 polypeptides. The pharmaceutical compositions contain pharmaceutically acceptable excipients, and can be formulated for any suitable route of administration, including, but not limited to, systemic, oral, nasal, pulmonary, local and topical administration. Also provided are kits containing any of the pharmaceutical compositions, a device for administration of the composition and, optionally, instructions for administration.

Nucleic acid molecules encoding the modified proteases, including the u-PA proteases and MT-SP 1 proteases and catalytically active portions thereof are provided. Also provided are vectors containing the nucleic acid molecules and cells containing the nucleic acid molecules or vectors.

Methods of treatment of subjects having a disease or condition, such as, but not limited to, a disease or condition selected from among arterial thrombosis, venous thrombosis and thromboembolism, ischemic stroke, acquired coagulation disorders, disseminated intravascular coagulation, bacterial infection and periodontitis, and neurological conditions, that is treated by administration of t-PA, by administering the pharmaceutical compositions containing the modified u-PA proteases or proteolytically active portions thereof or encoding nucleic acid molecules or the cells are provided. The methods are effected by administering a nucleic acid molecule, a cell or a pharmaceutical composition to the subject.

Also provided are methods of treating a subject having a disease or condition that is mediated by a VEGFR, particularly a VEGFR-2. Such diseases and conditions include, but are not limited to, cancer, angiogenic diseases, ophthalmic diseases, such as macular degeneration, inflammatory diseases, and diabetes, particularly complications therefrom, such as diabetic retinopathies. The methods are effected by administering a nucleic acid molecule or cell or composition containing or encoding the modified u-PA proteases that exhibit substrate specificity, particularly increased compared to the unmodified form, for VEGFR-2. The methods optionally include administering another agent for treatment of the disease or condition, such as administering an anti-tumor agent where the disease is cancer.

Also provided are methods of treating a subject having a disease or condition that is mediated by a complement protein, particularly C2. Such diseases and conditions include, but are not limited to sepsis, Rheumatoid arthritis (RA), membranoproliferative glomerulonephritis (MPGN), Multiple Sclerosis (MS), Myasthenia gravis (MG), asthma, inflammatory bowel disease, immune complex (IC)-mediated acute inflammatory tissue injury, Alzheimer's Disease (AD), Ischemia-reperfusion injury, and Guillan-Barre syndrome. In some examples, the ischemia-reperfusion injury is caused by an event or treatment, such as, but not limited to, myocardial infarct (MI), stroke, angioplasty, coronary artery bypass graft, cardiopulmonary bypass (CPB), and hemodialysis. The methods are effected by administering a nucleic acid molecule or cell or composition containing or encoding the modified MT-SP1 proteases that exhibit substrate specificity, particularly increased compared to the unmodified form, for C2. In other examples, the disease or conditions results from treatment of a subject. For example, the treatment can result in complement-mediated ischemia-reperfusion injury. Such treatments include, but are not limited to, angioplasty or coronary artery bypass graft. In such examples, a modified MT-SP1 protease is administered prior to treatment of a subject. The modified MT-SP1 polypeptides can be administered by contacting a body fluid or tissue sample in vitro, ex vivo or in vivo.

Also provided herein are modified serpin polypeptides used in the methods provided herein. Such modified serpin polypeptides are modified in its reactive site loop at positions corresponding to positions P4-P2' with a cleavage sequence for a target substrate. Typically, the target substrate is involved in the etiology of a disease or disorder. Such target substrates include, but are not limited to, a VEGFR, a complement protein or a t-PA substrates. For example, target substrates include VEGFR2 and complement protein C2. Exemplary of modified serpins provided herein are modified plasminogen-activator inhibitor-1 (PAI-1) and antithrombin-3 (AT3). Exemplary modified serpins are set forth in any of SEQ ID NOS: 497, 499, 610 and 611.

BRIEF DESCRIPTION OF THE FIGURES

FIG. 1 depicts the mechanism of inhibition of a protease by a serpin and the generation of a stable inhibited complex. Following contact, a serpin (I) and protease (E) initially form a noncovalent, Michaelis-like complex (E1). This is followed by cleavage of the P1-P1' scissile bond and nucleophilic attack by the catalytic serine of a protease on a reactive site loop (RSL) carbonyl of a serpin and the formation of a covalent acyl-enzyme intermediate ($EI^\#$). The kinetically trapped covalent inhibitory product ($EI^*$) is the result of RSL insertion, protease translocation, protease active site distortion, and deformation of the overall protease structure. The minor non-inhibitory pathway releases normal cleavage product, serpin ($I^*$), and reactive protease (E).

DETAILED DESCRIPTION

Outline
- A. Definitions
- B. Method for Screening Proteases
- C. Protease Trap Polypeptides
- 1. Serpins: Structure, Function, and Expression
- 2. Protease Catalysis, Inhibitory Mechanism of Serpins, and Formation of Acyl Enzyme Intermediate
  - a. Exemplary Serpins
    - i. PAI-1
    - ii. Antithrombin (AT3)
- 3. Other Protease Trap Polypeptides
  - a. p35
  - b. Alpha Macroglobulins (aM)
- 4. Protease Trap Polypeptide Competitors
- 5. Variant Protease Trap Polypeptides
- D. Proteases
- 1. Candidate Proteases
  - a. Classes of Proteases
    - i. Serine Proteases
      - (a) Urokinase-type Plasminogen Activator (u-PA)
      - (b) Tissue Plasminogen Activator (t-PA)
      - (c) MT-SP1
    - ii. Cysteine Proteases
- E. Modified Proteases and Collections for Screening
- 1. Generation of Variant Proteases
  - a. Random Mutagenesis
  - b. Focused Mutagenesis
- 2. Chimeric Forms of Variant Proteases
- 3. Combinatorial Libraries and Other Libraries
  - a. Phage Display Libraries
  - b. Cell Surface Display Libraries
  - c. Other Display Libraries
- F. Methods of Contacting, Isolating, and Identifying Selected Proteases
- 1. Iterative Screening
- 2. Exemplary Selected Proteases
- G. Methods of Assessing Protease Activity and Specificity
- H. Methods of Producing Nucleic Acids Encoding Protease Trap Polypeptides (i.e. Serpins) or Variants Thereof or Proteases/Modified Proteases
- 1. Vectors and Cells
- 2. Expression
  - a. Prokaryotic Cells
  - b. Yeast Cells
  - c. Insect Cells
  - d. Mammalian Cells
  - e. Plants
- 3. Purification Techniques
- 4. Fusion Proteins
- 5. Nucleotide Sequences
- I. Preparation, Formulation and Administration of Selected Protease Polypeptides
- 1. Compositions and Delivery
- 2. In vivo Expression of Selected Proteases and Gene Therapy
  - a. Delivery of Nucleic Acids
    - i. Vectors—Episomal and Integrating
    - ii. Artificial Chromosomes and Other Non-viral Vector Delivery Methods
    - iii. Liposomes and Other Encapsulated Forms and Administration of Cells Containing Nucleic Acids
  - b. In vitro and Ex vivo Delivery
  - c. Systemic, Local and Topical Delivery
- 2. Combination Therapies
- 3. Articles of Manufacture and Kits
- J. Exemplary Methods of Treatment with Selected Protease Polypeptides
- 1. Exemplary Methods of Treatment for Selected uPA Polypeptides That Cleave tPA Targets
  - a. Thrombotic Diseases and Conditions
    - i. Arterial Thrombosis
    - ii. Venous Thrombosis and Thromboembolism
      - (a) Ischemic stroke
    - iii. Acquired Coagulation Disorders
      - (a) Disseminated Intravascular Coagulation (DIC)
      - (b) Bacterial Infection and Periodontitis
  - b. Other tPA Target-associated Conditions
  - c. Diagnostic Methods
- 2. Exemplary Methods of Treatment for Selected Protease Polypeptides That Cleave VEGF or VEGFR Targets
  - a. Angiogenesis, Cancer, and Other Cell Cycle Dependent Diseases or Conditions
  - b. Combination Therapies with Selected Proteases That Cleave VEGF or VEGFR
- 3. Exemplary Methods of Treatment for Selected MT-SP1 Polypeptides that cleave complement protein targets
  - a. Immune-mediated Inflammatory Diseases
  - b. Neurodegenerative Disease
  - c. Cardiovascular Disease
- K. EXAMPLES

A. DEFINITIONS

Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, a "protease trap" or "protease trap polypeptide", refers to a substrate that is cleaved by a protease and that, upon cleavage, forms a stable complex with the protease to thereby trap the proteases as the protease goes through an actual transition state to form an enzyme complex, thereby inhibiting activity of the proteases and capturing it. Thus, protease traps are inhibitors of proteases. Protease traps are polypeptides or molecules that include amino acid residues that are cleaved by a protease such that upon cleavage a stable complex is formed. The complex is sufficiently stable to permit separation of complexes from unreacted trap or from trap that has less stable interactions with the proteases. Protease traps include any molecule, synthetic, modified or naturally-occurring that is cleaved by the protease and, upon cleavage, forms a complex with the protease to permit separation of the reacted protease or complex from unreacted trap.

Exemplary of such protease traps are serpins, modified serpins, molecules that exhibit a mechanism similar to serpins, such as for example, p35, and any other molecule that is cleaved by a protease and traps the protease as a stable complex, such as for example, alpha 2 macroglobulin. Also included as protease traps are synthetic polypeptides that are cleaved by a protease (or proteolytically active portion thereof) and, upon cleavage, form a stable complex with the protease or proteolytically active portion thereof.

As used herein, serpins refer to a group of structurally related proteins that inhibit proteases following cleavage of their reactive site by a protease resulting in the formation of a stable acyl-enzyme intermediate and the trapping of the protease in a stable covalent complex. Serpins include allelic and species variants and other variants so long as the serpin molecule inhibits a protease by forming a stable covalent complex. Serpins also include truncated or contiguous fragments of amino acids of a full-length serpin polypeptide that minimally includes at least a sufficient portion of the reactive site loop (RSL) to facilitate protease inhibition and the formation of a stable covalent complex with the protease. Exemplary serpins are set forth in Table 2 and/or have a sequence of amino acids set forth in any one of SEQ ID NOS: 1-38, allelic variants, or truncated portions thereof.

As used herein a "mutant" or "variant" serpin refers to a serpin that contains amino acid modifications, particularly modifications in the reactive site loop of the serpin. The modifications can be replacement, deletion, or substitution of one or more amino acids corresponding to $P_n$-$P_{15}$-$P_{14}$-$P_{13}$...$P_4$-$P_3$-$P_2$-$P_1$-$P_1'$-$P_2'$-$P_3'$...$P_n'$-positions. Typically, the serpin contains amino acid replacements in 1, 2, 3, 4, 5, 6, 7, 8, 9, 10 or more amino acid positions in the reactive site loop as compared to a wild-type serpin. Most usually, the replacements are in one or more amino acids corresponding to positions P4-P2'. For example, for the exemplary PAI-1 serpin set forth in SEQ ID NO: 11, the P4-P1' positions (VSARM) corresponding to amino acid positions 366-370 in SEQ ID NO: 11 can be modified. Example 1 describes modification of the VSARM (SEQ ID NO: 378) amino acid residues to RRVARM (SEQ ID NO: 379) or PFGRS (SEQ ID NO: 389).

As used herein, a "scissile bond" refers to the bond in a polypeptide cleaved by a protease and is denoted by the bond formed between the P1-P1' position in the cleavage sequence of a substrate.

As used herein, reactive site refers to the portion of the sequence of a target substrate that is cleaved by a protease. Typically, a reactive site includes the P1-P1' scissile bond sequence.

As used herein, reactive site loop (RSL; also called reactive center loop, RCL) refers to a sequence of amino acids in a serpin molecule (typically 17 to 22 contiguous amino acids) that serve as the protease recognition site and generally contain the sole or primary determinants of protease specificity. Cleavage of the RSL sequence and conformational changes thereof are responsible for the trapping of the protease by the serpin molecule in a stable covalent complex. For purposes herein, any one or more amino acids in the RSL loop of a serpin can be modified to correspond to cleavage sequences in a desired target protein. Such modified serpins, or portions thereof containing the variant RSL sequence, can be used to select for proteases with altered substrate specificity.

As used herein, partitioning refers to the process by which serpins partition between a stable serpin-protease complex versus cleaved serpins. The reason for partitioning in serpins pertains to the nature of the inhibitory pathway, which results from a large translocation of the cleaved reactive-site loop across the serpin surface. If the protease has time to dissociate (i.e. deacylate the enzyme-serpin complex) before adopting the inhibited location, then partitioning occurs. The outcome of a given serpin-protease interaction, therefore, depends on the partitioning ratio between the inhibitory ($k_4$) and substrate ($k_5$) pathways (such as is depicted in FIG. 1), which is represented by the stoichiometry of inhibition (SI=1+$k_5$/$k_4$); good inhibitors have the value of 1 because most of the serpin molecules partition into complex formation and $k_5$/$k_4$ is close to 0. If the RSL loop, however, is not inserted fast enough into the protease, partitioning occurs and the reaction proceeds directly to the cleaved product.

As used herein, catalytic efficiency or kcat/km is a measure of the efficiency with which a protease cleaves a substrate and is measured under steady state conditions as is well known to those skilled in the art.

As used herein, second order rate constant of inhibition refers to the rate constant for the interaction of a protease with an inhibitor. Generally the interaction of a protease with an inhibitor, such as a protease trap, such as a serpin, is a second order reaction proportional to the product of the concentration of each reactant, the inhibitor and the protease. The second order rate constant for inhibition of a protease by a tight binding or irreversible inhibitor or a protease trap is a constant, which when multiplied by the enzyme concentration and the inhibitor concentration yields the rate of enzyme inactivation by a particular inhibitor. The rate constant for each protease trap and enzyme pair uniquely reflects their interaction. As a second order reaction, an increase in the second order rate constant means that the interaction between a modified selected protease and inhibitor is faster compared to the interaction of an unmodified protease and the inhibitor. Thus, a change in the second order rate constant reflects a change in the interaction between the components, the protease and/or inhibitor, of the reaction. An increased second order rate constant when screening for proteases can reflect a desired selected modification in the protease.

As used herein, acyl enzyme intermediate refers to the covalent intermediate formed during the first step in the catalysis between a substrate and an essential serine in the catalytic center of a serine protease (typically Ser195, based on chymotrypsin numbering). The reaction proceeds as follows: the serine —OH attacks the carbonyl carbon at the P1 position of the substrate, the nitrogen of the histidine accepts the hydrogen from the —OH of the serine, and a pair of electrons from the double bond of the carbonyl oxygen moves to the oxygen. This results in the generation of a negatively charged tetrahedral intermediate. The bond joining the nitrogen and the carbon in the peptide bond of the substrate is now broken. The covalent electrons creating this bond move to attack the hydrogen of the histidine thereby breaking the connection. The electrons that previously moved from the carbonyl oxygen double bond move back from the negative oxygen to recreate the bond resulting in the formation of a covalent acyl enzyme intermediate. The acyl enzyme intermediate is hydrolyzed by water, resulting in deacylation and the formation of a cleaved substrate and free enzyme.

As used herein, a collection of proteases refers to a collection containing at least 10 different proteases and/or proteolytically active portions thereof, and generally containing at least 50, 100, 500, 1000, $10^4$, $10^5$ or more members. The collections typically contain proteases (or proteolytically active portions thereof) to be screened for substrate specificity. Included in the collections are naturally occurring proteases (or proteolytically active portions thereof) and/or modified proteases (or proteolytically active portions thereof). The modifications include random mutations along the length of the proteases and/or modifications in targeted or selected regions (i.e. focused mutations). The modifications can be combinatorial and can include all permutations, by substitution of all amino acids at a particular locus or at all loci or subsets thereof. The collections can include proteases of full length or shorter, including only the protease domain. The proteases can include any proteases, such as serine proteases and cysteine proteases. The size of the collection and particular collection is determined by the user. In other embodiments, the collection can contain as few as 2 proteases.

As used herein, "combinatorial collections" or "combinatorial libraries" refers to a collection of protease polypeptides having distinct and diverse amino acid mutations in its sequence with respect to the sequence of a starting template protease polypeptide sequence. The mutations represented in the collection can be across the sequence of the polypeptide or can be in a specified region or regions of the polypeptide sequence. The mutations can be made randomly or can be targeted mutations designed empirically or rationally based on structural or functional information.

As used herein, a "template protease" refers to a protease having a sequence of amino acids that is used for mutagenesis thereof. A template protease can be the sequence of a wild-type protease, or a catalytically active portion thereof, or it can be the sequence of a variant protease, or catalytically active portion thereof, for which additional mutations are made. For example, a mutant protease identified in the selection methods herein, can be used as a starting template for further mutagenesis to be used in subsequent rounds of selection.

As used herein, random mutation refers to the introduction of one or more amino acid changes across the sequence of a polypeptide without regard or bias as to the mutation. Random mutagenesis can be facilitated by a variety of techniques known to one of skill in the art including, for example, UV irradiation, chemical methods, and PCR methods (e.g., error-prone PCR).

As used herein, a focused mutation refers to one or more amino acid changes in a specified region (or regions) or a specified position (or positions) of a polypeptide. For example, targeted mutation of the amino acids in the specificity binding pocket of a protease can be made. Focused mutagenesis can be performed, for example, by site directed mutagenesis or multi-site directed mutagenesis using standard recombinant techniques known in the art.

As used herein, a stable complex between a protease trap and a protease or a proteolytically active portion thereof refers to a complex that is sufficiently stable to be separated from proteases that did not form complexes with the protease trap (i.e. uncomplexed proteases). Such complexes can be formed via any stable interaction, including covalent, ionic and hydrophobic interactions, but are sufficiently stable under the reaction conditions to remain complexed for sufficient time to separate complexes for isolation. Typically such interactions, such as between serpins and cleaved proteases, are covalent bonds.

As used herein, a "hot spot" refers to a position that is mutated in multiple variants resulting from the protease selection that exhibit improved activity and/or selectivity for the desired new substrate sequence. One or more "hot spots" can be identified during protease selection. Hence, such positions are specificity and/or selectivity determinants for the protease and thereby contribute to substrate specificity and also can occur as broad specificity and/or selectivity determinants across the corresponding locus in more than one member of a protease family, such as a serine protease family or a particular protease family, such as based on chymotrypsin numbering.

As used herein, desired specificity with reference to substrate specificity refers to cleavage specificity for a predetermined or preselected or otherwise targeted substrate.

As used herein, "select" or grammatical variations thereof refers to picking or choosing a protease that is in complex with a protease trap polypeptide. Hence, for purposes herein, select refers to pulling out the protease based on its association in stable complexes with a protease trap polypeptide. Generally, selection can be facilitated by capture of the covalent complexes, and if desired, the protease can be isolated. For example, selection can be facilitated by labeling the protease trap polypeptide, for example, with a predetermined marker, tag or other detectable moiety, to thereby identify the protease based on its association in the stable complex.

As used herein, "identify" and grammatical variations thereof refers to the recognition of or knowledge of a protease in a stable complex. Typically, in the methods herein, the protease is identified by its association in a stable complex with a protease trap polypeptide, which can be accomplished, for example, by amplification (i.e. growth in an appropriate host cell) of the bound proteases in the complex followed by DNA sequencing.

As used herein, labeled for detection or separation means that that the molecule, such as a protease trap polypeptide, is associated with a detectable label, such as a fluorophore, or is associated with a tag or other moiety, such as for purification or isolation or separation. Detectably labeled refers to a molecule, such as a protease trap polypeptide, that is labeled for detection or separation.

As used herein, reference to amplification of a protease or proteolytically active portion of a protease, means that the amount of the protease or proteolytically active portion is increased, such as through isolation and cloning and expression, or, where the protease or proteolytically active portion is displayed on a microorganism, the microorganism is introduced into an appropriate host and grown or cultured so that more displayed protease or proteolytically active portion is produced.

As used herein, homogeneous with reference to a reaction mixture means that the reactants are in the liquid phase as a mixture, including as a solution or suspension.

As used herein, recitation that a collection of proteases or proteolytically active portions of proteases is "based on" a particular protease means that the collection is derived from the particular protease, such as by random or directed mutagenesis or rational design or other modification scheme or protocol, to produce a collection.

As used herein, a disease or condition that is treated by administration of t-PA refers to a disease or condition for which one of skill in the art would administer t-PA. Such conditions include, but are not limited to, fibrinolytic conditions, such as arterial thrombosis, venous thrombosis and thromboembolism, ischemic stroke, acquired coagulation disorders, disseminated intravascular coagulation, and precursors thereto, such as bacterial or viral infections, periodontitis, and neurological conditions.

As used herein, a disease or condition that is mediated by VEGFR-2 is involved in the pathology or etiology. Such conditions include, but are not limited to, inflammatory and angiogenic conditions, such as cancers, diabetic retinopathies, and ophthalmic disorders, including macular degeneration.

As used herein, "proteases," "proteinases" and "peptidases" are interchangeably used to refer to enzymes that catalyze the hydrolysis of covalent peptidic bonds. These designations include zymogen forms and activated single-, two- and multiple-chain forms thereof. For clarity, reference to protease refers to all forms. Proteases include, for example, serine proteases, cysteine proteases, aspartic proteases, threonine and metallo-proteases depending on the catalytic activity of their active site and mechanism of cleaving peptide bonds of a target substrate.

As used herein, a zymogen refers to a protease that is activated by proteolytic cleavage, including maturation cleavage, such as activation cleavage, and/or complex formation with other protein(s) and/or cofactor(s). A zymogen is an inactive precursor of a proteolytic enzyme. Such precursors are generally larger, although not necessarily larger than the active form. With reference to serine proteases, zymogens are converted to active enzymes by specific cleavage, including catalytic and autocatalytic cleavage, or by binding of an activating co-factor, which generates an active enzyme. A zymogen, thus, is an enzymatically inactive protein that is converted to a proteolytic enzyme by the action of an activator. Cleavage can be effected autocatalytically Zymogens, generally, are inactive and can be converted to mature active polypeptides by catalytic or autocatalytic cleavage of the proregion from the zymogen.

As used herein, a "proregion," "propeptide," or "pro sequence," refers to a region or a segment that is cleaved to produce a mature protein. This can include segments that function to suppress enzymatic activity by masking the catalytic machinery and thus preventing formation of the catalytic intermediate (i.e., by sterically occluding the substrate binding site). A proregion is a sequence of amino acids positioned at the amino terminus of a mature biologically active polypeptide and can be as little as a few amino acids or can be a multidomain structure.

As used herein, an activation sequence refers to a sequence of amino acids in a zymogen that are the site required for activation cleavage or maturation cleavage to form an active protease. Cleavage of an activation sequence can be catalyzed autocatalytically or by activating partners.

Activation cleavage is a type of maturation cleavage in which a conformational change required for activity occurs. This is a classical activation pathway, for example, for serine proteases in which a cleavage generates a new N-terminus which interacts with the conserved regions of catalytic machinery, such as catalytic residues, to induce conformational changes required for activity. Activation can result in production of multi-chain forms of the proteases. In some instances, single chain forms of the protease can exhibit proteolytic activity as a single chain.

As used herein, domain refers to a portion of a molecule, such as proteins or the encoding nucleic acids, that is structurally and/or functionally distinct from other portions of the molecule and is identifiable.

As used herein, a protease domain is the catalytically active portion of a protease. Reference to a protease domain of a protease includes the single, two- and multi-chain forms of any of these proteins. A protease domain of a protein contains all of the requisite properties of that protein required for its proteolytic activity, such as for example, its catalytic center.

As used herein, a catalytically active portion or proteolytically active portion of a protease refers to the protease domain, or any fragment or portion thereof that retains protease activity. Significantly, at least in vitro, the single chain forms of the proteases and catalytic domains or proteolytically active portions thereof (typically C-terminal truncations) exhibit protease activity.

As used herein, a "nucleic acid encoding a protease domain or catalytically active portion of a protease" refers to a nucleic acid encoding only the recited single chain protease domain or active portion thereof, and not the other contiguous portions of the protease as a continuous sequence.

As used herein, recitation that a polypeptide consists essentially of the protease domain means that the only portion of the polypeptide is a protease domain or a catalytically active portion thereof. The polypeptide can optionally, and generally will, include additional non-protease-derived sequences of amino acids.

As used herein, "S1-S4" refers to amino acid residues that form the binding sites for P1-P4 residues of a substrate (see, e.g., Schecter and Berger (1967) *Biochem Biophys Res Commun* 27:157-162). Each of S1-S4 contains one, two or more residues, which can be non-contiguous. These sites are numbered sequentially from the recognition site N-terminal to the site of proteolysis, referred to as the scissile bond.

As used herein, the terms "P1-P4" and "P1'-P4'" refer to the residues in a substrate peptide that specifically interact with the S1-S4 residues and S1'-S4' residues, respectively, and are cleaved by the protease. P1-P4 refer to the residue positions on the N-terminal side of the cleavage site; P1'-P4' refer to the residue positions to the C-terminal side of the cleavage site. Amino acid residues are labeled from N to C termini of a polypeptide substrate (Pi, . . . , P3, P2, P1, P1', P2', P3', . . . , Pj). The respective binding sub-sites are labeled (Si, . . . , S3, S2, S1, S1', S2', S3', . . . , Sj). The cleavage is catalyzed between P1 and P1.'

As used herein, a "binding pocket" refers to the residue or residues that interact with a specific amino acid or amino acids on a substrate. A "specificity pocket" is a binding pocket that contributes more energy than the others (the most important or dominant binding pocket). Typically, the binding step precedes the formation of the transition state that is necessary for the catalytic process to occur. S1-S4 and S1'-S4' amino acids make up the substrate sequence binding pocket and facilitate substrate recognition by interaction with P1-P4 and P1'-P4' amino acids of a peptide, polypeptide or protein substrate, respectively. Whether a protease interacts with a substrate is a function of the amino acids in the S1-S4 and S1'-S4' positions. If the amino acids in any one or more of the S1, S2, S3, S4, S1', S2', S3' and S4' sub-sites interact with or recognize any one or more of the amino acids in the P1, P2, P3, P4, P1', P2', P3' and P4' sites in a substrate, then the protease can cleave the substrate. A binding pocket positions a target amino acid with a protease so that catalysis of a peptide bond and cleavage of a substrate is achieved. For example, serine proteases typically recognize P4-P2' sites in a substrate; other proteases can have extended recognition beyond P4-P2'.

As used herein, amino acids that "contribute to extended substrate specificity" refers to those residues in the active site cleft in addition to the specificity pocket. These amino acids include the S1-S4, S1'-S4' residues in a protease.

As used herein, secondary sites of interaction are outside the active site cleft. These can contribute to substrate recognition and catalysis. These amino acids include amino acids that can contribute second and third shell interactions with a substrate. For example, loops in the structure of a protease surrounding the S1-S4. S1'-S4' amino acids play a role in positioning P1-P4, P1'-P4' amino acids in the substrate thereby registering the scissile bond in the active site of a protease.

As used herein, active site of a protease refers to the substrate binding site where catalysis of the substrate occurs. The structure and chemical properties of the active site allow the recognition and binding of the substrate and subsequent hydrolysis and cleavage of the scissile bond in the substrate. The active site of a protease contains amino acids that contribute to the catalytic mechanism of peptide cleavage as well as amino acids that contribute to substrate sequence recognition, such as amino acids that contribute to extended substrate binding specificity.

As used herein, a "catalytic triad" or "active site residues" of a serine or cysteine protease refers to a combination of amino acids, typically three amino acids, that are in the active site of a serine or cysteine protease and contribute to the catalytic mechanism of peptide cleavage. Generally, a catalytic triad is found in serine proteases and provides an active nucleophile and acid/base catalysis. The catalytic triad of serine proteases contains three amino acids, which in chymotrypsin are $Asp^{102}$, $His^{57}$, and $Ser^{195}$. These residues are critical for the catalytic efficiency of a serine protease.

As used herein, the "substrate recognition site" or "cleavage sequence" refers to the sequence recognized by the active site of a protease that is cleaved by a protease. Typically, for example, for a serine protease, a cleavage sequence is made up of the P1-P4 and P1'-P4' amino acids in a substrate, where cleavage occurs after the P1 position. Typically, a cleavage sequence for a serine protease is six residues in length to match the extended substrate specificity of many proteases, but can be longer or shorter depending upon the protease. For example, the substrate recognition site or cleavage sequence of MT-SP 1 required for autocatalysis is RQARVV (SEQ ID NO: 637), where R is at the P4 position, Q is at the P3 position, A is at the P2 position and R is at the P1 position. Cleavage in MT-SP 1 occurs after position R followed by the sequence VVGG (SEQ ID NO: 638).

As used herein, target substrate refers to a substrate that is specifically cleaved at its substrate recognition site by a protease. Minimally, a target substrate includes the amino acids that make up the cleavage sequence. Optionally, a target substrate includes a peptide containing the cleavage sequence and any other amino acids. A full-length protein, allelic variant, isoform, or any portion thereof, containing a cleavage sequence recognized by a protease, is a target substrate for that protease. Additionally, a target substrate includes a peptide or protein containing an additional moiety that does not affect cleavage of the substrate by a protease. For example, a target substrate can include a four amino acid peptide or a full-length protein chemically linked to a fluorogenic moiety.

As used herein, cleavage refers to the breaking of peptide bonds by a protease. The cleavage site motif for a protease involves residues N- and C-terminal to the scissile bond (the unprimed and primed sides, respectively, with the cleavage site for a protease defined as . . . P3-P2-P1-P1'-P2'-P3' . . . , and cleavage occurs between the P1 and P1' residues). Typically, cleavage of a substrate is an activating cleavage or an inhibitory cleavage. An activating cleavage refers to cleavage of a polypeptide from an inactive form to an active form. This includes, for example, cleavage of a zymogen to an active enzyme, and/or cleavage of a progrowth factor into an active growth factor. For example, MT-SP1 can auto-activate by cleaving a target substrate at the P1-P4 sequence of RQAR (SEQ ID NO: 513). An activating cleavage also is cleavage whereby a protein is cleaved into one or more proteins that themselves have activity. For example, activating cleavage occurs in the complement system, which is an irreversible cascade of proteolytic cleavage events whose termination results in the formation of multiple effector molecules that stimulate inflammation, facilitate antigen phagocytosis, and lyse some cells directly.

As used herein, an inhibitory cleavage is cleavage of a protein into one or more degradation products that are not functional. Inhibitory cleavage results in the diminishment or reduction of an activity of a protein. Typically, a reduction of an activity of a protein reduces the pathway or process for which the protein is involved. In one example, the cleavage of any one or more target proteins, such as for example a VEGFR, that is an inhibitory cleavage results in the concomitant reduction or inhibition of any one or more functions or activities of the target substrate. For example, for cleavage of a VEGFR, activities that can be inhibited include, but are not limited to, ligand binding, kinase activity, or angiogenic activity such as angiogenic activity in vivo or in vitro. To be inhibitory, the cleavage reduces activity by at least about 10%, 20%, 30%, 40%, 50%, 60%, 70%, 80%, 90%, 95%, 99.9% or more compared to a native form of the protein. The percent cleavage of a protein that is required for the cleavage to be inhibitory varies among proteins but can be determined by assaying for an activity of the protein.

As used herein, a protease polypeptide is a polypeptide having an amino acid sequence corresponding to any one of the candidate proteases, or variant proteases thereof described herein.

As used herein, a "modified protease," or "mutein protease" refers to a protease polypeptide (protein) that has one or more modifications in primary sequence compared to a wild-type or template protease. The one or more mutations can be one or more amino acid replacements (substitutions), insertions, deletions and any combination thereof. A modified protease polypeptide includes those with 1, 2, 3, 4, 5, 6, 7, 8, 9, 10, 11, 12, 13, 14, 15, 16, 17, 18, 19, 20, or more modified positions. A modified protease can be a full-length protease, or can be a catalytically active portion thereof of a modified full length protease as long as the modified protease is proteolytically active. Generally, these mutations change the specificity and activity of the wild-type or template proteases for cleavage of any one or more desired or predetermined target substrates. In addition to containing modifications in regions that alter the substrate specificity of a protease, a modified protease also can tolerate other modifications in regions that are non-essential to the substrate specificity of a protease. Hence, a modified protease typically has 60%, 70%, 80%, 85%, 90%, 91%, 92%, 93%, 94%, 95%, 96%, 97%, 98%, 99% or more sequence identity to a corresponding sequence of amino acids of a wildtype or scaffold protease. A modified full-length protease or a catalytically active portion thereof of a modified protease can include proteases that are fusion proteins as long as the fusion itself does not alter substrate specificity of a protease.

As used herein, chymotrypsin numbering refers to the amino acid numbering of a mature chymotrypsin polypeptide of SEQ ID NO:391. Alignment of a protease of the chymotrypsin family (i.e. u-PA, t-PA, MT-SP 1, and others), including the protease domain, can be made with chymotrypsin. In such an instance, the amino acids of the protease that correspond to amino acids of chymotrypsin are given the numbering of the chymotrypsin amino acids. Corresponding positions can be determined by such alignment by one of skill in the art using manual alignments or by using the numerous alignment programs available (for example, BLASTP). Corresponding positions also can be based on structural alignments, for example by using computer simulated alignments of protein structure. Recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm. For example, upon alignment of u-PA with the mature chymotrypsin polypeptide amino acid C168 in the precursor sequence of u-PA set forth in SEQ ID NO: 191 aligns with amino acid C1 of the mature chymotrypsin polypeptide. Thus, amino acid C168 in u-PA also is C1 based on chymotrypsin numbering. Using such a chymotrypsin numbering standard, amino acid L244 in the precursor u-PA sequence set forth in SEQ ID NO:191 is the same as L73 based on chymotrypsin numbering and amino acid and I260 is the same as I89 based on chymotrypsin numbering. In another example, upon alignment of the serine protease domain of MT-SP1 (corresponding to amino acids 615 to 855 in SEQ ID NO:253) with mature chymotrypsin, V at position 615 in MT-SP1 is given the chymotrypsin numbering of V16. Subsequent amino acids are numbered accordingly. Thus, an F at amino acid position 708 of full-length MT-SP1 (SEQ ID NO:253), corresponds to F99 based on chymotrypsin numbering. Where a residue exists in a protease, but is not present in chymotrypsin, the amino acid residue is given a letter notation. For example, residues in chymotrypsin that are part of a loop with amino acid 60 based on chymotrypsin numbering, but are inserted in the MT-SP1 sequence compared to chymotrypsin, are referred to for example as Asp60b or Arg60c.

As used herein, specificity for a target substrate refers to a preference for cleavage of a target substrate by a protease compared to another substrate, referred to as a non-target substrate. Specificity is reflected in the second order rate constant or specificity constant ($k_{cat}/K_m$), which is a measure of the affinity of a protease for its substrate and the efficiency of the enzyme.

As used herein, a specificity constant for cleavage is ($k_{cat}/K_m$), wherein $K_m$ is the Michaelis-Menton constant ([S] at one half $V_{max}$) and $K_{cat}$ is the $V_{max}/[E_T]$, where $E_T$ is the final enzyme concentration. The parameters $k_{cat}$, $K_m$ and $k_{cat}/K_m$ can be calculated by graphing the inverse of the substrate concentration versus the inverse of the velocity of substrate cleavage, and fitting to the Lineweaver-Burk equation (1/velocity=$(K_m/V_{max})(1/[S])+1/V_{max}$; where $V_{max}=[E_T]k_{cat}$). Any method to determine the rate of increase of cleavage over time in the presence of various concentrations of substrate can be used to calculate the specificity constant. For example, a substrate is linked to a fluorogenic moiety, which is released upon cleavage by a protease. By determining the rate of cleavage at different enzyme concentrations, $k_{cat}$ can be determined for a particular protease. The specificity constant can be used to determine the site specific preferences of an amino acid in any one or more of the S1-S4 pockets of a protease for a concomitant P1-P4 amino acid in a substrate using standard methods in the art, such as a positional scanning combinatorial library (PS-SCL). Additionally, the specificity constant also can be used to determine the preference of a protease for one target substrate over another substrate.

As used herein, a substrate specificity ratio is the ratio of specificity constants and can be used to compare specificities of two or more proteases or a protease for two more substrates. For example, substrate specificity of a protease for competing substrates or of competing proteases for a substrate can be compared by comparing $k_{cat}/K_m$. For example, a protease that has a specificity constant of $2\times10^6$ $M^{-1}$ $sec^{-1}$ for a target substrate and $2\times10^4$ $M^{-1}$ $sec^{-1}$ for a non-target substrate is more specific for the target substrate. Using the specificity constants from above, the protease has a substrate specificity ratio of 100 for the target protease.

As used herein, preference for a target substrate can be expressed as a substrate specificity ratio. The particular value of the ratio that reflects a preference is a function of the substrates and proteases at issue. A substrate specificity ratio that is greater than 1 signifies a preference for a target substrate and a substrate specificity less than 1 signifies a preference for a non-target substrate. Generally, a ratio of at least or about 1 reflects a sufficient difference for a protease to be considered a candidate therapeutic.

As used herein, altered specificity refers to a change in substrate specificity of a modified or selected protease compared to a starting wild-type or template protease. Generally, the change in specificity is a reflection of the change in preference of a modified protease for a target substrate compared to a wildtype substrate of the template protease (herein referred to as a non-target substrate). Typically, modified proteases or selected proteases provided herein exhibits increased substrate specificity for any one or more predetermined or desired cleavage sequences of a target protein compared to the substrate specificity of a template protease. For example, a modified protease or selected protease that has a substrate specificity ratio of 100 for a target substrate versus a non-target substrate exhibits a 10-fold increased specificity compared to a scaffold protease with a substrate specificity ratio of 10. In another example, a modified protease that has a substrate specificity ratio of 1 compared to a ratio of 0.1, exhibits a 10-fold increase in substrate specificity. To exhibit increased specificity compared to a template protease, a modified protease has a 1.5-fold, 2-fold, 5-fold, 10-fold, 50-fold, 100-fold, 200-fold, 300-fold, 400-fold, 500-fold or more greater substrate specificity for any one of more of the predetermined target substrates.

As used herein, "selectivity" can be used interchangeably with specificity when referring to the ability of a protease to choose and cleave one target substrate from among a mixture of competing substrates. Increased selectivity of a protease for a target substrate compared to any other one or more target substrates can be determined, for example, by comparing the specificity constants of cleavage of the target substrates by a protease. For example, if a protease has a specificity constant of cleavage of $2\times10^6$ $M^{-1}$ $sec^{-1}$ for a target substrate and $2\times10^4$ $M^{-1}$ $sec^{-1}$ for any other one of more substrates, the protease is more selective for the former target substrate.

As used herein, activity refers to a functional activity or activities of a polypeptide or portion thereof associated with a full-length (complete) protein. Functional activities include, but are not limited to, biological activity, catalytic or enzymatic activity, antigenicity (ability to bind to or compete with a polypeptide for binding to an anti-polypeptide antibody), immunogenicity, ability to form multimers, and the ability to specifically bind to a receptor or ligand for the polypeptide.

As used herein, catalytic activity or cleavage activity refers to the activity of a protease as assessed in in vitro proteolytic assays that detect proteolysis of a selected substrate. Cleavage activity can be measured by assessing catalytic efficiency of a protease.

As used herein, activity towards a target substrate refers to cleavage activity and/or functional activity, or other measurement that reflects the activity of a protease on or towards a target substrate. Cleavage activity can be measured by assessing catalytic efficiency of a protease. For purposes herein, an activity is increased if a protease exhibits greater proteolysis or cleavage of a target substrate and/or modulates (i.e. activates or inhibits) a functional activity of a target substrate protein as compared to the absence of the protease.

As used herein, serine protease or serine endopeptidases refers to a class of peptidases, which are characterized by the presence of a serine residue in the active center of the enzyme. Serine proteases participate in a wide range of functions in the body, including blood clotting, inflammation as well as digestive enzymes in prokaryotes and eukaryotes. The mechanism of cleavage by "serine proteases," is based on nucleophilic attack of a targeted peptidic bond by a serine. Cysteine, threonine or water molecules associated with aspartate or metals also can play this role. Aligned side chains of serine, histidine and aspartate form a catalytic triad common to most serine proteases. The active site of serine proteases is shaped as a cleft where the polypeptide substrate binds. Exemplary serine proteases include urinary plasminogen activator (u-PA) set forth in SEQ ID NO: 433 and MT-SP1 set forth in SEQ ID NO:253, and catalytically active portions thereof, for example the MT-SP1 protease domain (also called the B-chain) set forth in SEQ ID NO:505.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, the residues of naturally occurring α-amino acids are the residues of those 20 α-amino acids found in nature which are incorporated into protein by the specific recognition of the charged tRNA molecule with its cognate mRNA codon in humans.

As used herein, non-naturally occurring amino acids refer to amino acids that are not genetically encoded.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3552-3559 (1969), and adopted 37 C.F.R. §§ 1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |
| D | Asp | aspartic acid |
| N | Asn | asparagines |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, "naturally occurring amino acids" refer to the 20 L-amino acids that occur in polypeptides.

As used herein, "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, an isokinetic mixture is one in which the molar ratios of amino acids has been adjusted based on their reported reaction rates (see, e.g., Ostresh et al., (1994) Biopolymers 34:1681).

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term ortholog means a polypeptide or protein obtained from one species that is the functional counterpart or a polypeptide or protein from a different species. Sequence differences among orthologs are the result of speciation.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule can not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carillo, H. & Lipton, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing. Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I): 387 (1984)), BLASTP, BLASTN, FASTA (Atschul, S. F., et al., *J Molec Biol* 215:403 (1990)); Guide to Huge Computers, Martin J. Bishop, ed., Academic Press, San Diego, 1994, and Carillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman ((1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations n proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, species variants refer to variants in polypeptides among different species, including different mammalian species, such as mouse and human.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, a peptidomimetic is a compound that mimics the conformation and certain stereochemical features of the biologically active form of a particular peptide. In general, peptidomimetics are designed to mimic certain desirable properties of a compound, but not the undesirable properties, such as flexibility, that lead to a loss of a biologically active conformation and bond breakdown. Peptidomimetics can be prepared from biologically active compounds by replacing certain groups or bonds that contribute to the undesirable properties with bioisosteres. Bioisosteres are known to those of skill in the art. For example the methylene bioisostere $CH_2S$ has been used as an amide replacement in enkephalin analogs (see, e.g., Spatola (1983) pp. 267-357 in Chemistry and Biochemistry of Amino Acids, Peptides, and Proteins, Weinstein, Ed. volume 7, Marcel Dekker, New York). Morphine, which can be administered orally, is a compound that is a peptidomimetic of the peptide endorphin. For purposes herein, cyclic peptides are included among peptidomimetics as are polypeptides in which one or more peptide bonds is/are replaced by a mimic.

As used herein, a polypeptide comprising a specified percentage of amino acids set forth in a reference polypeptide refers to the proportion of contiguous identical amino acids shared between a polypeptide and a reference polypeptide. For example, an isoform that comprises 70% of the amino acids set forth in a reference polypeptide having a sequence of amino acids set forth in SEQ ID NO:XX, which recites 147 amino acids, means that the reference polypeptide contains at least 103 contiguous amino acids set forth in the amino acid sequence of SEQ ID NO:XX.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than about or at 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight) 20%, 10%, 5% or less of chemical precursors or non-protease chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means by using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, an adenovirus refers to any of a group of DNA-containing viruses that cause conjunctivitis and upper respiratory tract infections in humans. As used herein, naked DNA refers to histone-free DNA that can be used for vaccines and gene therapy. Naked DNA is the genetic material that is passed from cell to cell during a gene transfer processed called transformation. In transformation, purified or naked DNA is taken up by the recipient cell which will give the recipient cell a new characteristic or phenotype.

As used herein, operably or operatively linked when referring to DNA segments means that the segments are arranged so that they function in concert for their intended purposes, e.g., transcription initiates in the promoter and proceeds through the coding segment to the terminator.

As used herein, protein binding sequence refers to a protein or peptide sequence that is capable of specific binding to other protein or peptide sequences generally, to a set of protein or peptide sequences or to a particular protein or peptide sequence.

As used herein, epitope tag refers to a short stretch of amino acid residues corresponding to an epitope to facilitate subsequent biochemical and immunological analysis of the epitope tagged protein or peptide. Epitope tagging is achieved by adding the sequence of the epitope tag to a protein-encoding sequence in an appropriate expression vector. Epitope tagged proteins can be affinity purified using highly specific antibodies raised against the tags.

As used herein, metal binding sequence refers to a protein or peptide sequence that is capable of specific binding to metal ions generally, to a set of metal ions or to a particular metal ion.

As used herein the term assessing is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomasie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, an agent that modulates the activity of a protein or expression of a gene or nucleic acid either decreases or increases or otherwise alters the activity of the protein or, in some manner, up- or down-regulates or otherwise alters expression of the nucleic acid in a cell.

As used herein, a pharmaceutical effect or therapeutic effect refers to an effect observed upon administration of an agent intended for treatment of a disease or disorder or for amelioration of the symptoms thereof.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity) a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, inhibit and inhibition refer to a reduction in an activity relative to the uninhibited activity.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related. A kit is a packaged combination that optionally includes instructions for use of the combination or elements thereof.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving complement activation, including those mediated by complement activation and those in which complement activation plays a role in the etiology or pathology. Diseases and disorders also include those that are caused by the absence of a protein such as an immune deficiency, and of interest herein are those disorders where complement activation does not occur due to a deficiency in a complement protein.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein, a therapeutic agent, therapeutic regimen, radioprotectant, or chemotherapeutic mean conventional drugs and drug therapies, including vaccines, which are known to those skilled in the art. Radiotherapeutic agents are well known in the art.

As used herein, treatment means any manner in which the symptoms of a condition, disorder or disease or other indication, are ameliorated or otherwise beneficially altered.

As used herein therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, an effective amount is the quantity of a therapeutic agent necessary for preventing, curing, ameliorating, arresting or partially arresting a symptom of a disease or disorder.

As used herein, administration of a protease, such as a modified protease, refers to any method in which the protease is contacted with its substrate.

Administration can be effected in vivo or ex vivo or in vitro. For example, for ex vivo administration a body fluid, such as blood, is removed from a subject and contacted outside the body with the modified non-complement protease. For in vivo administration, the modified protease can be introduced into the body, such as by local, topical, systemic and/or other route of introduction. In vitro administration encompasses methods, such as cell culture methods.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold.

As used throughout this application, the term is intended to encompass modified protease polypeptides and nucleic acids contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a combination of a modified protease polypeptide or nucleic acid molecule provided herein and another item for a purpose including, but not limited to, administration, diagnosis, and assessment of a biological activity or property. Kits optionally include instructions for use.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The proteases provided herein are from any source, animal, plant, prokaryotic and fungal. Most proteases are of animal origin, including mammalian origin.

As used herein, a control refers to a sample that is substantially identical to the test sample, except that it is not treated with a test parameter, or, if it is a sample plasma sample, it can be from a normal volunteer not affected with the condition of interest. A control also can be an internal control.

As used herein, the singular forms "a," "an" and "the" include plural referents unless the context clearly dictates otherwise. Thus, for example, reference to compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Method for Screening Proteases

Provided are methods for screening for proteases with altered properties, particularly substrate specificity and selectivity. The methods also provide such altered proteases that exhibit substantially unchanged or with sufficient activity for a therapeutic use. The methods provided herein can be employed with any method for protease modification and design of modified proteases. Such methods include random methods for producing libraries, use of existing libraries, and also directed evolution methods A variety of selection schemes to identify proteases having altered substrate specificity/selectivity have been employed, but each has limitations. The methods provided herein overcome such limitations. Generally, selection schemes include those that 1) select for protease binding or 2) select for protease catalysis. Examples of strategies that take advantage of protease binding include, for example, the use of transition state analogues (TSAs) and those that employ small molecule suicide substrates. A TSA is a stable compound that mimics the electronic and structural features of the transition state of a protease: substrate reaction. The strongest interaction between a protease and the substrate typically occurs at the transition state of a reaction. A TSA is employed as a model substrate to select for proteases with high binding affinity. A TSA is never a perfect mimic of a true transition state and their syntheses are difficult (Bertschinger et al. (2005) in *Phage display in Biotech. and Drug Discovery* (Sidhu S, ed), pp. 461-491). Such a strategy has identified protease variants with altered substrate specificity, but such proteases generally exhibit reduced activity because a requirement for protease catalysis is not part of the selection scheme.

In an alternate strategy, small molecule suicide substrates (also called mechanism-based inhibitors) have been used to select for proteases based on binding. Such suicide substrates typically are small molecule inhibitors that bind covalently to the active site of an enzyme. These suicide substrates contain a reactive electrophile that reacts with an enzymes nucleophile to form a covalent bond. Cleavage of a natural peptide bond by the protease is not required for this reaction. Typically, such inhibitors produce a reactive nucleophile only upon binding to the correct enzyme and undergoing normal catalytic steps (see, e.g., Bertschinger et al. (2005) in *Phage display in Biotech. and Drug Discovery* (Sidhu S, ed), pp. 461-491). In many cases, the substrate inhibitor mimics the conformation of the first transition state involved in catalysis, but do not allow completion of the catalytic cycle. As a result, the use of such inhibitors effectively selects for strong binding instead of catalysis and results in the selection of inactive enzymes with impaired dissociation of the substrate (Droge et al. (2006) Chem Bio Chem, 7:149-157). Also, due to their size and the lack of requirement for cleavage of the substrate, they do not recapitulate the interaction of a protease with a natural protein substrate.

A protease selection strategy that selects for catalysis instead of binding also has been attempted (see, e.g., Heinis et al. (2001), *Protein Engineering*, 14: 1043-1052). One of the major limitations in assaying for catalysis is that reaction products diffuse away quickly after the reaction is complete making it difficult to isolate the catalytically active enzyme. Consequently, strategies that select for catalysis rely on anchoring the substrate and the enzyme to phage such that they are in close proximity. For example, the protein calmodulin has been used as an immobilization agent (Demartis (1999) J. Mol. Biol., 286:617-633). Reaction substrates are non-covalently anchored on calmodulin-tagged phage enzymes using calmodulin-binding peptide derivatives. Following catalysis, phage displaying the reaction product are isolated from non-catalytically active phage using anti-product affinity reagents. Since the substrate is attached to the phage particle, however, the catalysis reaction can be hindered. Therefore, these and other methods for protease selection, suffer limitations and do not identify proteases with altered specificity and substantially unchanged with sufficient activity for therapeutic applications. The methods provided herein address these limitations.

Provided herein are method of protease selection to identify proteases and/or protease variants with altered, optimized or improved substrate specificity. Such proteases are identified for optimization and use as therapeutic proteases that can cleave and inactivate (or activate) desired protein targets such as, for example, protein targets involved in the etiology of a disease or disorder. In the methods for screening proteases provided herein, candidate proteases are trapped as stable intermediate complexes of the protease enzymatic reaction, and then identified. The stable intermediate complexes typically are covalent complexes or other complexes that permit separation thereof from non-complexed molecules. Such intermediates, include, for example, an acyl enzyme intermediate, that permits capture and ultimately identification of the proteases that have a selected or predetermined substrate specificity. Capture (trapping) of the protease is effected by contacting a collection of proteases with a protease trap polypeptide that is cleaved by the protease, and, upon cleavage, forms the stable complex. Exemplary of such protease trap polypeptides are serpins, alpha 2 macroglobulin, and other such molecules. The protease trap polypeptide can be naturally-occurring and/or can be modified to select for a particular target substrate.

In practicing the methods, collections of proteases, typically modified or mutant proteases and/or collections of natural proteases, are contacted with a protease trap polypeptide that reacts with the protease following substrate cleavage to form the complex containing the trapped intermediate. These methods can be used to identify proteases having a desired substrate specificity/selectivity. To achieve identification of proteases having a desired substrate specificity/selectivity, the amino acid sequence of the scissile bond, and/or surrounding sequences in the reactive site, such as the reactive loop sequence or analogous sequence, can be modified in the protease trap polypeptide to mimic the substrate cleavage sequence of a desired target substrate.

The screening reaction is performed by contacting a collection of proteases with the protease trap polypeptide under conditions whereby stable complexes, typically covalent complexes form. The complexes are of sufficient stability to permit their separation from other less stable complexes and unreacted protease trap polypeptides.

The protease trap polypeptides can be identifiable labeled or affinity-tagged to facilitate identification of complexes. For example, labeling of the protease trap polypeptides, such as by a fluorescent moiety, affinity tag or other such labeling/tagging agent facilitates the isolation of the protease-inhibitor complex and identification of the selected protease. Selected proteases can be analyzed for activity to assess proteolytic efficiency and substrate specificity. The identified or selected proteases also can be identified, such as by sequencing or other identification protocol, including mass spectrometric methods, or by other labeling methods, to identify selected proteases in the complexes.

The methods provided herein also include optional iterative screening steps, such that the method can be performed once, or can be performed in multiple rounds hone in on proteases of a desired or predetermined specificity/selectivity and/or cleavage activity. For example, proteases selection can include randomly or empirically or systematically modifying the selected protease (in targeted regions and/or along the length), and repeating (in one, two, three, four or more rounds) the method of contacting the proteases collection with one or more protease trap polypeptide.

The methods provided herein can be multiplexed, such as by including two or more differentially labeled or differentially identifiable protease trap polypeptides.

In the methods provided herein, it is not necessary that the protease trap polypeptide exhibit 100% or even very high efficiency in the complexing reaction as long as at least a detectable percentage, typically at least 1%, 2%, 5%, 10%, 20%, 30%, 40%, 50%, 60%, 70%, 80%, 90% or more, can form a stable complex that can be separated or otherwise identified from among less stable complexes or unreacted protease trap polypeptides. Thus, proteases can be selected where partitioning occurs in the reaction in which there is than 100% inhibition by the protease trap polypeptide, such as for example, 1%, 5%, 10%, 20%, 30%, 40%, 50%, 60%, 70%, 80% 90%, 95%, 99% or more inhibition of protease catalyzed reaction. In the methods provided herein, the stringency of the selection and other parameters can be modulated, such as by controlling reaction time, temperature, pH, ionic strength, and/or library and substrate concentrations. Specificity constraints also can be modulated during selection by including competitors such as, for example, specific competitors containing an undesired substrate cleavage sequence or broader classes of competitors, such as for example, human plasma.

The method provided herein also can be performed by contacting a collection of proteases with one protease trap polypeptide or mixtures of different protease trap polypeptides such as by multiplexing. Where a plurality of different protease trap polypeptides are used, each protease trap polypeptide can be individually and distinctly labeled so that they can be identifiably detected. Such a method enables the isolation and identification of multiple proteases from a collection of proteases in a single reaction.

The methods provided herein permit collections of proteases to be screened at once to identify those having a desired or predetermined substrate specificity. The collections of proteases include, any collection of proteases, including collections of various wild-type proteases, modified proteases, mixtures thereof, and also proteolytically active portions thereof. Any collection can be employed. The collections also can be made as a set of mutant proteases, or proteolytically active portions thereof that contain the mutation. Such collections include, combinatorial collections in which members in the collection contain diverse mutations. The mutation can be random along the length of a protease (or catalytically active portion thereof) or can be targeted to a particular position or region, such as for example, the specificity binding pocket of the protease. The methods provided herein can identify and discover non-contact residues not previously appreciated to be involved as specificity determinants (i.e. buried residues). Hence, the protease selection technology method provided herein can be used to create proteases with entirely new specificities and activities and/or to optimize the specificity or activity of an existing protease lead.

C. Protease Trap Polypeptides

A protease trap polypeptide used in the methods provided herein is a polypeptide, or a polypeptide portion containing a reactive site, that serves as a substrate for a protease that upon cleavage results in the formation of a protease-substrate intermediate complex, that is stable. Generally, such a protease trap polypeptide is one that requires cleavage of a scissile bond (P1-P1') by the protease to yield the generation of a trapped substrate-protease complex. The stable complex is typically an irreversible complex formed through the tight interactions between the protease and the protease trap polypeptide, such as due to covalent, ionic, hydrophobic, or other tight linkages. As such the complex is generally stable for hours, days, weeks, or more thereby permitting isolation of the complex. In one example, the stable intermediate complex can be an acyl enzyme intermediate that is formed upon reaction of a serine or cysteine protease with a protease trap polypeptide. Most usually, following protease trap polypeptide cleavage a rapid conformational change in the complex distorts the protease and prevents deacylation of the acyl-enzyme complex. Thus, panning proteases with protease trap polypeptides allows selection for the rate limiting step of catalysis (i.e. cleavage of the P1-P1' bond and acylation of the enzyme) while at the same time forming very tight (i.e. covalent) complexes that are easily isolated from collection mixtures.

Typically, such protease trap polypeptides are large (greater than 100 amino acids), single domain proteins containing a reactive site sequence recognized by a protease. Generally, the reactive site cleavage sequence is part of a larger reactive loop that is flexible, exposed, and long to make it a target substrate (Otlewski et al. (2005) *The EMBO J.* 24: 1303-1310), however, so long as the protease trap contains a reactive site sequence that can be cleaved by a protease, thereby mimicking substrate cleavage, it can be used in the methods provided herein. Thus, any large polypeptide or synthetically produced polypeptide that contains a scissile bond cleaved by a protease resulting in the trapping of a protease in a long-lasting, stable complex can be used in the methods provided herein. Exemplary of such protease trap polypeptides are serpins, such as any described herein. Other protease trap polypeptides also can be used in the methods provided herein, such as any whose mechanism of action is similar to those of serpin molecules. These include, for example, synthetic or recombinantly generated serpin-like molecules, or polypeptides containing contiguous fragments or sequences of a serpin molecule including a sufficient portion of a reactive site loop of a serpin molecule. In addition, other protease inhibitors whose mechanism of inhibition is similar to that of serpins can be used, such as for example, the baculovirus p35 protein that inhibits caspases (Xu et al. (2001) *Nature,* 410:494-497; Otlewski et al. (2005) *The EMBO J.* 24: 1303-1310). Other protease trap polypeptides include any that trap a protease in a stable complex that can be easily isolated, such as, but not limited to, alpha 2 macroglobulin.

1. Serpins Structure, Function, and Expression

Serpins (serine protease inhibitors) are protease inhibitors that are large protein molecules (about 330-500 amino acids) compared to other serine protease inhibitors that are normally about less than 60 amino acids. The serpin superfamily is the largest and most broadly distributed of protease inhibitors. Over 1,500 serpin family members have been identified to date in a variety of different animals, poxviruses, plants, bacteria, and archaea (Law et al. (2006) *Genome Biology,* 7:216), with over thirty different human serpins studied thus far. Most human serpins are found in the blood where they function in a wide range of regulatory roles including, for example, inflammatory, complement, coagulation, and fibrinolytic cascades. Serpins also function intracellularly to perform cytoprotective roles, such as for example, regulating the inappropriate release of cytotoxic proteases. Although most serpins have an inhibitory role on protease activity, some serpins perform other non-inhibitory roles such as but not limited to, hormone transport, corticosteroid binding globulin, and blood pressure regulation (Silverman et al. (2001) *JBC,* 276: 33293-33296). Among non-inhibitory serpins are steroid binding globulins and ovalbumin. Typically, serpins inhibit the action of serine proteases, although several serpins have been identified that are inhibitors of papain-like cysteine proteases or caspases (Whisstock et al. (2005) *FEBS Journal,* 272: 4868-4873).

The sequence identity among serpin family members is weak, however, their structures are highly conserved. For example, members of the serpin family share about 30% amino acid sequence homology with the serpin alpha1-antitrypsin and have a conserved tertiary structure. Structurally, serpins are made up of three β sheets (A, B, and C) and 8-9 α-helices (A-I), which are organized into an upper β-barrel domain and a lower helical domain. The two domains are bridged by the five stranded B-sheet A, which is the main structural feature of serpins (Huntington et al. (2003), *J Thrombosis and Haemostasis,* 1:1535-1549). Serpins are metastable proteins such that they are only partially stable in their active form; they require protease to adopt a completely stable conformation. A loop, termed the reactive site loop (RSL), is responsible for the altered conformation of the serpin molecule. The RSL is an exposed stretch of about 17 amino acid residues that protrudes out from the top of the molecule in a region between the A and C β-sheets. The RSL serves as the protease recognition site, and generally contains the sole determinants of protease specificity. The most stable form of the serpin structure is the RSL-cleaved form. Following protease cleavage, the amino terminal portion of the RSL inserts into the center of β-sheet A to become strand four of the six-stranded β-sheet. This conformational change is termed the "stressed" to "relaxed" (or S to R) transition. This transformation is characterized by an increase in thermal stability of the molecule owing to the reorganization of the five-stranded β-sheet A to a six-stranded anti-parallel form (Lawrence et al. (2000), *J. Biol. Chem.,* 275: 5839-5844). In other words, the native structure of serpins is equivalent to a latent intermediate, which is only converted to a more stable structure following protease cleavage (Law et al. (2006) *Genome Biology,* 7:216).

Typically, serpins target serine proteases, although some serpins inhibit cysteine proteases using a similar mechanism. The RSL loop determines which proteases are targeted for inhibition as it provides a pseudo-substrate for the target protease. In effect, the inhibitory specificity of a particular serpin is mediated by the RSL sequence, which is the most variable region among serpins (Travis et al. (1990) *Biol. Chem. Hoppe Seyler,* 371: 3-11). The RSL mimics the substrate recognition sequence of a protease and thereby contains a reactive site numbered as . . . $P_n$-$P_3$-$P_2$-$P_1$-$P_1'$-$P_2'$-$P_3'$-$P_n'$ . . . , where the reactive site is the scissile bond between $P_1$ and $P_1'$. For mature α1-antitrypsin, cleavage at the P1-P1' bond occurs at the $Met_{358}$-$Ser_{359}$ bond (corresponding to amino acids $Met_{382}$ and $Ser_{389}$ of the sequence of amino acids set forth in SEQ ID NO:1). The corresponding binding site for the residues on the protease are . . . $S_n$-$S_3$-$S_2$-$S_1$-$S_1'$, $S_2'$, $S_3'$, $S_n'$ . . . . In the method provided herein, modification of the RSL sequence is made to select for proteases from a display library exhibiting altered substrate specificity, as discussed in detail below.

2. Protease Catalysis, Inhibitory Mechanism of Serpins, and Formation of Acyl Enzyme Intermediate The protease selection method provided herein exploits the ability of polypeptides to trap proteases, such as is exemplified by serpins, to identify proteases with altered substrate specificity. Mechanisms of protease catalysis differ slightly between classes of proteolytic enzymes: serine, cysteine, aspartic, threonine, or metallo-proteases. For example, serine peptidases have a serine residue involved in the active center, the aspartic have two aspartic acids in the catalytic center, cysteine-type peptidases have a cysteine residue, threonine-type peptidases have a threonine residue, and metallo-peptidases use a metal ion in the catalytic mechanism. Generally, those proteases families that form covalent intermediates are the target of the protease selection method provided herein. These include, for example, members of the serine and cysteine protease family. As an example, for serine proteases, the first step in catalysis is the formation of an acyl enzyme intermediate between the substrate and the serine in the catalytic center of the protease. Formation of this covalent intermediate proceeds through a negatively charged tetrahedral transition state intermediate and then the P1-P1' peptide bond of the substrate is cleaved. During the second step or deacylation, the acyl-enzyme intermediate is hydrolyzed by a water molecule to release the peptide and to restore the Ser-hydroxyl of the enzyme. The deacylation, which also involves the formation of a tetrahedral transition state intermediate, proceeds through the reverse reaction pathway of acylation. For deacylation, a water molecule is the attacking nucleophile instead of the Ser residue. The H is residue in the catalytic center of a serine protease provides a general base and accepts the OH group of the reactive Ser.

Serpins inhibit the catalysis reaction of both serine and cysteine target proteases using the S to R transition as mentioned above. Their mechanism of action is unique among protease inhibitors by destroying the active site of the protease before deacylation progresses, thereby irreversibly impeding proteolysis following the formation of the acyl-enzyme intermediate (Otlewski et al. (2005) *The EMBO Journal*, 24: 1303). The kinetic model of the reaction of a serpin with a protease is identical to that of proteolysis of a substrate (see e.g., FIG. 1; Zhou et al. (2001) *J. Biol. Chem.*, 276: 27541-27547). Following interaction with a target protease, the serpin initially forms a non-covalent Michaelis-like complex through interactions of residues in the RSL flanking the P1-P1' scissile bond (Silverman et al. (2001), *J. Biol. Chem.*, 276: 33293-33296). The serine residue (for serine proteases), in the active site of the protease attacks the P1-P1' bond, facilitating cleavage of the peptide bond and formation of a covalent ester linkage between the serine residue and the backbone carbonyl of the P1 residue. After the RSL is cleaved, the RSL inserts into β-sheet A of the serpin molecule. The first residue to insert is P14 (i.e. amino acid 345 in mature α1-antitrypsin, which corresponds to amino acid position T369 in the sequence of amino acids set forth in SEQ ID NO: 1), and is followed by the flexible hinge region (P15-P9) of the RSL (Buck et al. (2005) *Mol. Biol. Evol.*, 22: 1627-1634). Insertion of the RSL transports the covalently bound protease with it, resulting in a conformational change of the protease characterized by a distorted active site (see FIG. 1) as well as a transition of the serpin into a "relaxed" state. The conformational change of the protease alters the catalytic triad of the active site such that the P1 side chain is removed from the S1 pocket. The net result of the conformational rearrangements is trapping of the acyl enzyme intermediate (Silverman et al. (2001), *J. Biol. Chem.*, 276: 33293-33296).

The formation of an acyl enzyme is important to the serpin interaction, and therefore, serpins are typically specific for classes of proteases that have acyl enzyme intermediates in catalysis. Among these classes of proteases are predominantly members of the serine protease family including those in the chymotrypsin superfamily and those in the subtilisin superfamily of proteases, which are described in more detail below. Additionally, serpins also are reactive against cysteine proteases including, for example, those in the papain family and the caspases family of serine proteases. Typically, serpins do not inhibit proteases of the metallo-, threonine, or aspartic families. For example, interactions of serpins with metalloproteases do not result in a covalent trapped intermediate, but instead the metalloprotease cleaves the inhibitor without the formation of any complex (Li et al. (2004) *Cancer Res.* 64: 8657-8665).

Thus, although most serpins inhibit serine proteases of the chymotrypsin family, cross-class inhibitors do exist that inhibit cysteine proteases. Among cross-class inhibitors are the viral serpin CrmA and PI9 (SEPRINB9) that both inhibit caspases 1, and SCCA1 (SERPINB3) that inhibits papain-like cysteine proteases including cathepsins L, K, and S. The mechanism of serpin-mediated inhibition of serine proteases appears to be adapted to cysteine proteases as well. The difference, however, is that the kinetically trapped intermediate is a thiol ester rather than an oxy ester as is the case for serine proteases (Silverman et al. (2001) *J. Biol. Chem.*, 276: 33293-33296). The existence of a stable, covalent thiol ester-type linkage is supported by the detection of an SDS-stable complex between SCCA1 and cathepsin S (Silverman et al. (2001) *J. Biol. Chem.*, 276:33293-33296; Schick et al. (1998) *Biochemistry*, 37:5258-5266).

The serpin-protease pair is highly stable for weeks up to years depending on the serpin-protease pair, however, dissociation eventually will occur to yield the products of normal proteolysis (i.e. the cleaved serpin and the active protease; see e.g., Zhou et al. (2001) *J. Biol. Chem.*, 276: 27541-27547). Further, if the RSL loop is not inserted fast enough into the protease, the reaction proceeds directly to the cleaved product. This phenomenon is termed partitioning and reflects the existence of a branched pathway that can occur leading to either a stable inhibitory complex or turnover of the serpin into a substrate such as is depicted in FIG. 1 as the formation of an inhibited complex versus the non-inhibitory pathway (Lawrence et al. (2000), *J Biol. Chem.*, 275: 5839-5844). Partitioning of a serpin can be modulated by changing residues in the RSL loop, particularly in the hinge region of the RSL which initiates loop insertion (i.e. P14), or by altering the protease for which the serpin optimally interacts. For example, the inhibitory activity of the serpin plasminogen activator inhibitor-1 (PAI-1) differs between the proteases uPA, tPA, and thrombin, with a targeted preference for uPA and tPA. Further, variation of the RSL loop at, for example, the P14 position of the hinge region alters the targeted preference of PAI-1: mutation to charged amino acids (i.e. Arg, Lys, Asp, Glu) reduces the inhibitory activity of PAI-1 to each of uPA, tPA, and thrombin; mutation to neutral amino acids (i.e. His, Tyr, Gln, Asn) or to Gly which lacks a side chain results in a 10-100-fold reduced inhibitory activity of PAI-1 to tPA and thrombin as compared to uPA; and mutation to hydrophobic amino acids does not change the inhibitory activity of PAI-1 as compared to wildtype PAI-1 (Lawrence et al. (2000), *J. Biol. Chem.*, 275: 5839-5844).

An important factor in the success of the serpin-mediated inhibition of protease catalysis is the length of the RSL loop, which must be of a precise length to ensure that the serpin and protease interact in a way that provides leverage between the body of the serpin and protease to allow for displacement of the catalytic serine from the active site and deformation of the protease (Zhou et al. (2001) *J. Biol. Chem.*, 276: 27541-27547; Huntington et al. (2000) *Nature*, 407:923-926). In effect, the protease is crushed against the body of the serpin. Most serpins have an RSL that is 17 residues in length, while only a few have been identified with loops of 16 residues (i.e. α2-antiplasmin, C1-inhibitor, and CrmA). An α2-antiplasmin variant serpin having an 18 residue loop also has been identified from a patient with a bleeding disorder, although this variant is not a functional inhibitory serpin (Zhou et al.

(2001) *J. Biol. Chem.*, 276: 27541-27547). Thus, the serpin inhibitory mechanism can accommodate a shortening, but not a lengthening, of the RSL (Zhou et al. (2001) *J. Biol. Chem.*, 276: 27541-27547). In addition to a conservation of loop length among serpin family members, the RSLs of serpins also generally retain a conserved hinge region (P15-P9) composition and do not typically contain charged or bulky P residues.

a. Exemplary Serpins

Serpins used in the method provided herein can be any serpin polypeptide, including but not limited to, recombinantly produced polypeptides, synthetically produced polypeptides and serpins extracted from cells, tissues, and blood. Serpins also include allelic variants and polypeptides from different species including, but not limited to, animals of human and non-human origin, poxviruses, plants, bacteria, and archaea. Typically, an allelic or species variant of a serpin differs from a native or wildtype serpin by about or at least 40%, 50%, 60%, 70%, 80%, 90%, 91%, 92%, 93%, 94%, 95%, 96%, 97%, 98%, or 99%. Human serpins include any serpin provided herein (e.g., in Table 2 below), allelic variant isoforms, synthetic molecules from nucleic acids, proteins isolated from human tissues, cells, or blood, and modified forms of any human serpin polypeptide. Serpins also include truncated polypeptide fragments so long as a sufficient portion of the RSL loop is present to mediate interaction with a protease and formation of a covalent acyl enzyme intermediate.

TABLE 2

Exemplary Serpins

| | Serpin | Protein name | Nickname | Function | Acc. # | Mature Polypeptide (aa) | SEQ ID NO |
|---|---|---|---|---|---|---|---|
| Extracellular inhibitory Serpins | SERPINA1 | Alpha-1-antitrypsin | A1AT | Inhibits elastase | P01009 | 25-418 | 1 |
| | SERPINA2 | Alpha-1-antitrypsin-related protein | A1AU | May be a pseudogene | P20848 | 22-420 | 2 |
| | SERPINF2 | Alpha-2-antiplasmin | A2AP | Inhibits plasmin and trypsin | P08697 | 40-491 | 3 |
| | SERPINA3 | Alpha-1-antichymotrypsin | AACT | Inhibits neutrophil cathepsin G and mast cell cymase | P01011 | 24-423 | 4 |
| | SERPINC1 | Antithrombin-III | ANT3 | Regulates blood coagulation cascade; thrombin and factor Xa inhibitor | P01008 | 33-464 | 5 |
| | SERPIND1 | Heparin cofactor II | HEP2 | Regulates blood coagulation cascade; thrombin inhibitor | P05546 | 20-499 | 6 |
| | SERPING1 | Plasma protease C1 inhibitor | IC1 | Regulation of complement activation, blood coagulation, fibrinolysis and the generation of kinins; C1 esterase inhibitor | P05155 | 23-500 | 7 |
| | SERPINA5 | Plasma serine protease inhibitor, Protein C inhibitor | IPSP, PAI-3 | Inhibits activated protein C and plasminogen activators | P05154 | 20-406 | 8 |
| | SERPINA4 | Kallistatin | KAIN, PI4 | Inhibits amidolytic and kininogenase activities of human tissue kallikrein | P29622 | 21-427 | 9 |
| | SERPINI1 | Neuroserpin | NEUS, PI12 | Formation or reorganization of synaptic connections and synaptic plasticity; inhibitor of tPA, uPA, and plasmin | Q99574 | 17-410 | 10 |

TABLE 2-continued

Exemplary Serpins

| | Serpin | Protein name | Nick-name | Function | Acc. # | Mature Poly-peptide (aa) | SEQ ID NO |
|---|---|---|---|---|---|---|---|
| | SERPINE1 | Plasminogen activator inhibitor-1 | PAI1 | Regulation of fibrinolysis; inhibitor of thrombin, uPA, tPA, and plasmin | P05121 | 24-402 | 11 |
| | SERPIN12 | Myoepithelium-derived serine proteinase inhibitor | PI14 | Inhibition of cancer metastasis | O75830 | 19-405 | 12 |
| | SERPINA10 | Protein Z-dependent protease inhibitor | ZP1 | Inhibits factor Z and XI | Q9UK55 | 22-444 | 13 |
| | SERPINE2 | Protease nexin I, glia-derived nexin precursor | PI7, GDN, PN-1 | Inhibition of uPA and tPA | P07093 | 20-398 | 14 |
| Intra-cellular inhibitory Serpins | SERPINB1 | Leukocyte elastase inhibitor, monocytes neutrophil elastase inhibitor | ILEU | Inhibition of neutrophil protease | P30740 | 1-379 | 15 |
| | SERPINB2 | Plasminogen activator inhibitor-2 | PAI2 | Tissue-type plasminogen activator, intracellular signaling; inhibition of uPA | P05120 | 1-415 | 16 |
| | SERPINB6 | Placental thrombin inhibitor | PTI6 | Inhibits thrombin | P35237 | 1-376 | 17 |
| | SERPINB10 | Bomapin | SB10, PI10 | Haematopoiesis, inhibition of thrombin and trypsin | P48595 | 1-397 | 18 |
| | SERPINB11 | epipin | SB11 | | Q96P15 | 1-392 | 19 |
| | SERPINB12 | Yukopin | SB12 | Inhibits trypsin and plasmin | Q96P63 | 1-405 | 20 |
| | SERPINB13 | Headpin | SB13, PI13 | Proliferation or differentiation of keratinocytes, inhibition of cathepsins L and K | Q9UIV8 | 1-391 | 21 |
| | SERPINB3 | Squamous cell carcinoma antigen 1 | SCC1 | Modulates immune response towards tumors, inhibition of cathepsins L, K, S and V, and papain | P29508 | 1-390 | 22 |
| | SERPINB4 | Squamous cell carcinoma antigen 2 | SCC2 | Modulates immune response towards tumors, inhibition of Cathepsin G and chymase | P48594 | 1-390 | 23 |
| | SERPINB7 | Megsin | SPB7 | Maturation of megakaryocytes | O75635 | 1-390 | 24 |
| | SERPINB8 | Cytoplasmic antiproteinase 8 | SPB8, PI8 | Inhibition of Furin | P50452 | 1-374 | 25 |
| | SERPINB9 | Cytoplasmic antiproteinase 9 | SPB9, PI9 | Granzyme B inhibitor | P50453 | 1-376 | 26 |
| | SERPINB6 | Proteinase inhibitor-6, placental thrombin inhibitor | PI6, PTI | Inhibition of cathepsin G, inhibits thrombin | P35237 | 1-376 | 27 |

TABLE 2-continued

Exemplary Serpins

| Serpin | Protein name | Nick-name | Function | Acc. # | Mature Polypeptide (aa) | SEQ ID NO |
|---|---|---|---|---|---|---|
| Non-inhibitory serpins | | | | | | |
| SERPINA8 | Angiotensinogen | ANGT | Blood pressure regulation, hormone precursor | P01019 | 34-485 | 28 |
| SERPINA6 | Corticosteroid-binding globulin | CBG | Hormone carrier (glucocorticoids and progestins), cortisol binding | P08185 | 23-405 | 29 |
| SERPINH1 | 47 kDa heat shock protein | HS47 | Molecular chaperone for collagen | P29043 | 18-417 | 30 |
| SERPINF1 | Pigment epithelium-derived factor | PEDF | Induces neuronal differentiation in retinoblastoma cells; inhibitor of angiogenesis | P36955 | 20-418 | 31 |
| SERPINB5 | Maspin | MASP | Tumor suppressor, prevents metastasis | P36952 | 1-375 | 32 |
| SERPINH2 | Collagen-binding protein 2 | SIH2 | Molecular chaperone for collagen | P50454 | 19-418 | 33 |
| SERPINA7 | Thyroxine-binding protein | THBG | Thyroid hormone transport, thyroxine binding | P05543 | 21-415 | 34 |
| SERPINA9 | Germinal center B-cell expressed transcript 1 protein | GCET1 | Maintenance of naive B cells | Q86WD7 | 24-417 | 35 |
| SERPINA12 | Vaspin | | Insulin-sensitizing adipocytokine | Q8IW75 | 21-414 | 36 |
| SERPINA11 | | | | Q86U17 | 20-422 | 37 |
| SERPINA13 | | | | Q6UXR4 | 22-307 | 38 |

Typically, a serpin used in the method provided herein is an inhibitory serpin, or fragment thereof, capable of forming a covalent acyl enzyme intermediate between the serpin and protease. Generally, such a serpin is used to select for proteases normally targeted by the serpin where close to complete inhibition of the protease occurs and partitioning is minimized between the inhibitory complex and cleaved serpin substrate. Table 3 depicts examples of serine proteases and their cognate serpin inhibitors. Such serpin/protease pairs are expected to have a high association constant or second ordered rate constant of inhibition and low or no partitioning into a non-inhibitory complex. For example, the major physiological inhibitor of t-PA is the serpin PAI-1, a glycoprotein of approximately 50 kD (Pannekoek et al. (1986) *EMBO J.*, 5:2539-2544; Ginsberg et al., (1980) *J. Clin. Invest.*, 78:1673-1680; and Carrell et al. In: *Proteinase Inhibitors*, Ed. Barrett, A. J. et al., Elsevier, Amsterdam, pages 403-420 (1986). Other serpin/protease pairs also can be used in the methods provided herein, however, even where association constants are lower and partitioning is higher. For example, although the association constants of other serpins, such as C1 esterase inhibitor and alpha-2-antiplasmin with tPA are orders of magnitude lower than that of PAI-1 (Ranby et al. (1982) *Throm. Res.*, 27:175-183; Hekman et al. (1988) *Arch. Biochem. Biophys.*, 262:199-210), these serpins nevertheless inhibit tPA (see e.g., Lucore et al. (1988) *Circ.* 77:660-669).

TABLE 3

| Serine Protease | Cognate Serpin Inhibitor |
|---|---|
| Activated protein C | Protein C inhibitor |
| | PAI-1 |
| C1 esterase | C1 esterase inhibitor |
| Cathepsin G | Alpha-1-antitrypsin |
| | Alpa-1-antichymotrypsin |
| Chymase | Alpha-1-antichymotrypsin |
| Chymotrypsin | Alpha-1-antichymotrypsin |
| | Alpha-2-antiplasmin |
| | Contrapsin |
| Coagulation Factors | Antithrombin III |
| (VIIa, Xa, XIa, XIIa) | C1 esterase inhibitor |
| Elastase | Alpha-1-antitrypsin |
| Kallikrein | C1 esterase inhibitor |
| | Alpha-1-antitrypsin |
| Plasmin | Alpha-2-antiplasmin |
| Thrombin | Antithrombin III |
| | Heparin cofactor II |
| tPA | PAI-1, PAI-2, PAI-3 |
| Trypsin | Alpha-1-antitrypsin |
| | Growth hormone regulated protein |
| Trypsin-like protease | Protease nexin I |
| u-PA | PAI-1, PAI-2, PAI-3 |

Thus, generally a serpin used for selection of a protease in the methods provided herein yields a reaction product where 80%, 90%, 93%, 94%, 95%, 96%, 97%, 98%, 99%, or 100% of the reaction product is the formation of the inhibitory complex. In some cases, however, increased partitioning between a serpin and protease can occur in the methods provided herein, such as if the serpin used in the method does not optimally target the protease. Thus, in the method provided herein a serpin can be used to select a protease where the resulting reaction leads to at or about 20%, 30%, 40%, 50%, 60%, 70%, 75%, or more of a stable inhibitory complex and the remaining product is a cleaved serpin substrate. Factors that can be altered to optimize for protease selection where partitioning occurs include, for example, increased serpin concentration and increased reaction time. In some instances, other non-inhibitory serpins, or mutants thereof as discussed below, can be used in the methods provided herein so long as the target protease for selection is able to interact with the serpin substrate to yield a covalent inhibitory complex that can be captured.

i. PAI-1

Exemplary of serpins used in the protease selection methods is plasminogen activator inhibitor-1 (PAI-1), or variants thereof. PAI-1 is the main inhibitor of tissue plasminogen activator (t-PA) and urokinase or urinary-plasminogen activator (u-PA), which are proteases involved in fibrinolysis due to the activation of plasminogen. PAI-1 has a second order rate constant for t-PA and u-PA of about $2 \times 10^7$ $M^{-1}$ $s^{-1}$. PAI-1 is involved in tumor invasion, fibrinolysis, cell migration, tissue remodeling, tissue involution, ovulation, inflammation, trophoblast invasion, and malignant transformation (Salonen et al. (1988) *J. Biol. Chem.*, 264: 6339-6343). PAI-1 is mainly produced by the endothelium, but also is secreted by other tissue types, such as for example, adipose tissue. Other related plasminogen activator inhibitors include PAI-2 and PAI-3. PAI-2, for example, also is an inhibitor of u-PA and t-PA, but is secreted by the placenta and typically is only present in high amounts during pregnancy.

PAI-1 is a single chain glycoprotein having a precursor sequence set forth in SEQ ID NO:11, including a 23 amino acid signal sequence, which when cleaved results in a 379 amino acid mature sequence. Like other serpins, PAI-1 transitions from a latent form into an active form following cleavage by a protease at its P1-P1' reactive site located at $Arg^{346}$-$Met^{347}$ (i.e. corresponding to amino acids $Arg^{369}$ and $Met^{370}$ of a precursor sequence set forth in SEQ ID NO:11), thereby resulting in the formation of a stable covalent complex and the inactivation of the bound protease. Unlike other serpins, however, PAI-1 adopts a latent transition spontaneously resulting in an inactive, highly stable but covalently intact form whereby residues P15 to P4 of the RSL insert into the β-sheet A to form strand four of the β-sheet (i.e. s4A), and residues P3 to P10' form an extended loop at the surface of the molecule (De Taeye et al. (2003) *J. Biol. Chem.*, 278: 23899-23905). Thus, active PAI-1 is relatively unstable at 37° C. exhibiting a half-life of only 2.5 hours before spontaneous conversion to a latent conformation. This latent form, however, can be reactivated by denaturation, such as by denaturation with sodium dodecyl sulfate, guanidinium chloride, and urea (Declerek et al. (1992) *J. Biol. Chem.*, 267: 11693-11696) and heat (Katagiri et al. (1988) *Eur J. Biochem.*, 176: 81-87). The active form of PAI-1 also is stabilized by interaction with vitronectin. Mutant PAI-1 have been identified that are unable to undergo conversion to a latent conformation and are therefore more stable at elevated temperature and pH for extended times periods (see e.g., Berkenpas et al. (1995) *The EMBO J.*, 14:2969-2977).

Modifications of serine proteases (i.e. t-PA or u-PA) and/or of the inhibitory serpin (i.e. PAI-1) have been made to modulate or alter the secondary rate constants of inhibition so as to make proteases resistant to inhibition by their cognate serpin inhibitor, or variant thereof, such as for use in therapeutic applications where activity of the wild-type protease is desired (see e.g., U.S. Pat. Nos. 5,866,413; 5,728,564; 5,550,042; 5,486602; 5,304,482).

ii. Antithrombin (AT3)

Another exemplary serpin, or variant thereof, for use in the methods herein is antithrombin (AT3). AT3 also is a member of the serpin family and inactivates a number of enzymes, including for example, those from the coagulation system such as, but not limited to, Factor X, Factor IX, Factor II (thrombin), Factor VII, Factor XI, and Factor XII. Typically, antithrombin is predominantly found in the blood where it, for example, prevents or inhibits coagulation by blocking the function of thrombin. The activity of AT3 is increased by the presence of one or more cofactors, typically heparin. Upon interaction with heparin, AT3 undergoes a conformational rearrangement involving loop expulsion away from serpin structure and P1 exposure resulting in an AT3 structure having an exposed protease-accessible conformation. In addition, heparin can bind to both the protease and inhibitor thereby accelerating the inhibitory mechanism (Law et al. (2006) *Genome Biology*, 7(216): 1-11).

The gene sequence for AT3 codes for a seven exon spanning DNA, encoding a precursor protein set forth in SEQ ID NO:5. Cleavage of the signal sequence corresponding to amino acids 1-32 of the sequence set forth in SEQ ID NO:5 results in a mature protein of 432 amino acids that has a molecular weight of about 58,000 daltons. Six of the amino acids are cysteines, which results in the formation of three intramolecular disulfide bonds. The P4-P2' positions in the RSL of AT3 contain the amino acid residues IAGRSL (SEQ ID NO:478), which correspond to amino acids 422-427 in the sequence of amino acids set forth in SEQ ID NO:5, where cleavage at the reactive site P1-P1' occurs between amino acids $Arg^{425}$-$Ser^{426}$.

3. Other Protease Trap Polypeptides

Additional protease trap polypeptides are known in the art or can be identified that exhibit a mechanism of inhibition similar to serpins (e.g. cleavage of the target substrate by a protease that produces a stable intermediate and a conformational change in the structure of the protease). Such protease trap polypeptides are contemplated for use in the method provided herein. Exemplary of such a protease trap polypeptide is p35. In addition, any other molecule that is cleaved by a protease resulting in the trapping of a protease in a long-lasting, stable complex can be used in the methods provided herein.

a. p35

For example, the baculovirus p35 protein (SEQ ID NO: 473), which is a broad spectrum caspase inhibitor, can inhibit caspases in this manner (Xu et al. (2001) *Nature* 410:494-497; Xu et al. (2003) *J. Biol. Chem.* 278(7):5455-5461). Cleavage of the $P_1$-$P_1'$ bond of p35 (at the caspase cleavage site $DQMD^{87}$; SEQ ID NO: 639) by caspases produces a covalent thioester intermediate between the amino segment of p35 loop (Asp87) and the cysteine residue of the caspase catalytic triad (Cys350 in caspase-8). Upon formation of the thioester linkage, the protease undergoes a conformational change allowing the amino segment of the cleaved loop to bury into the caspase, while the N-terminus of p35 containing a Cys residue at position 2 inserts into the caspase active site, thus blocking solvent accessibility of His 317 residue in caspase-8. Inaccessibility to the hydrolytic water molecule thus prevents subsequent hydrolysis of thioester bond.

Similar viral caspase inhibitors in addition to p35 include, but are not limited to, p49 (SEQ ID NO: 491) and the serpin CrmA cowpox gene (SEQ ID NO: 492). The p49 inhibitor exhibits a caspase inhibition mechanism similar to that of p35 in that a stable thioester linkage is formed with the active site of the caspase upon cleavage of the p49 caspase recognition sequence TVTD$^{94}$(SEQ ID NO: 640).

Target substrates for the screening using the methods provided herein can include a viral caspase inhibitor polypeptide, such as a p35, p49 or CrmA polypeptide. Methods of modification of the RSL loop of serpins provided herein can be easily adapted to modification of viral caspase inhibitor polypeptides. For example, the target site for cleavage in the p35 RSL can be modified to so as to select for proteases that have an altered reactivity or specificity for a target substrate. In wild-type p35, caspase recognition is found at amino acid positions 84-87 (DQMD$^{87}$; (SEQ ID NO: 6). Modifications to viral caspase inhibitor polypeptides can thus include modifications that alter the cleavage sequence and/or surrounding amino acid residues. For example, such modified caspase inhibitor polypeptides, such as for example a p35, p49 or CrmA polypeptide, can be designed to mimic the cleavage sequence of a desired target substrate, such as for example, a target substrate involved in the etiology of a disease or disorder. Any modification in the RSL loop sequence of a viral caspase inhibitor polypeptide can be made in the methods provided herein.

Viral caspase inhibitor polypeptides such as a p35, p49 or CrmA polypeptide, used in the methods provided herein can be any viral caspase inhibitor polypeptide, including but not limited to, recombinantly produced polypeptides, synthetically produced polypeptides and p35 pr p49 polypeptide produced by baculovirus purification methods. Viral caspase inhibitor polypeptides also include allelic variants of polypeptides, such as p35, p49 or CrmA polypeptide variants.

b. Alpha Macroglobulins (aM)

The alpha macroglobulin (aM) family of proteases include protease inhibitors such as the exemplary protease inhibitor alpha-2-macroglobulin (a2M; SEQ ID NO:490), and are contemplated for use as protease traps in the methods provided herein. aM molecules inhibit all classes of proteases. aM protease traps are characterized by a similar inhibition mechanism involving cleavage of a bait region of the inhibitor by a protease. The bait region is a segment that is susceptible to proteolytic cleavage, and which, upon cleavage, initiates a conformational change in the aM molecule resulting in the collapse of the structure around the protease. For the exemplary a2M sequence set forth in SEQ ID NO:490, the bait region corresponds to amino acids 690-728. In the resulting aM-protease stable complex, the active site of the protease is sterically shielded, thereby decreasing access to normal protease substrates. Typically, the trapped protease remains active against small peptide substrates, but loses its ability to interact with large protein substrates or inhibitors. In addition, aM molecules are characterized by the presence of a reactive thiol ester, which inactivates the inhibitory capacity by reaction of the thiol ester with amines. Further, the conformational change that occurs upon cleavage of the bait region exposes a conserved COOH-terminal receptor binding domain (RBD). Exposure of the RBD sequence facilitates the removal of the aM-protease complex from circulation.

4. Protease Trap Competitors

Competitors can be used in the methods provided herein to modulate the specificity and selectivity constraints of a selected protease for a target substrate. The competitors can be contacted with the protease, or collections thereof, at any time, such as before or after contact of the protease with the desired protease trap polypeptide or the competitor and desired protease trap polypeptide can be contacted with the protease simultaneously. Competitors can be specific competitors or broad competitors.

Specific competitors are designed that mimic a predetermined non-target substrate and thereby act as predetermined potential off-targets. Typically, such competitors are not labeled, so that stable protease complexes that form are not selected for. In addition, such competitors are added in large excess, typically molar excess, over the designed protease trap polypeptide used in the selection scheme, such that the competitors bind up the undesired proteases in the collection. In one example of specific competition, two different protease trap polypeptides, each designed to mimic different substrate recognition, are contacted with a collection of proteases where only one of the protease trap polypeptides is detectably labeled. For example, a competitor can include a polypeptide protease trap that is designed to have its reactive site mimic the cleavage sequence of a non-target substrate. Thus, a competitor, such as a serpin, can be designed to have its P4-P1' RSL residues replaced by the cleavage sequence of a predetermined non-target substrate. The competitor can be used in methods in combination with a protease trap polypeptide, such as for example another serpin polypeptide, whose RSL sequence has been modified to contain amino acids in the P4-P1' positions that mimic the cleavage sequence of a desired or predetermined target substrate, and that is labeled for isolation thereof. Thus, both protease trap polypeptides select for proteases exhibiting selectivity for the target or non-target cleavage sequence, but only those stable protease complexes that exhibit the desired target substrate specificity and that are detectably labeled can be isolated from the reaction. Other examples of specific competitors include, for example, the native protease trap polypeptide for which the reactive site has been modified in the methods provided herein. Example 6 exemplifies such a strategy where a plasma purified AT3 serpin is used as a competitor against the modified serpin AT3$^{SLGR-KI}$.

Broad competitors also can be used in the methods provided herein to constrain the specificity and selectivity of selected proteases. Examples of broad competitors include, for example, human plasma or human serum which contains a variety of natural protease inhibitors. Alternatively, a broad small molecule library of protease trap polypeptides can be generated where every position of P2, P3, or P4 is made to be different, such as for example an Acxxx-Thiaphine library.

5. Variant Protease Trap Polypeptides

Protease trap polypeptides that have been modified in their reactive site to have an altered cleavage sequence can be used in the methods provided herein to select for proteases with a desired or predetermined target substrate. Thus, protease traps are modified in the region of their sequence that serves as the recognized cleavage site of a protease so as to select for proteases that have an altered reactivity or specificity for a target substrate. For example, serpins can be modified to have an altered cleavage sequence at or around the scissile bond in the RSL loop. In another example, a2M can be modified in its bait region to have an altered cleavage sequence. Such modified protease traps can be designed to mimic the cleavage sequence of a desired target substrate, such as for example, a target substrate involved in the etiology of a disease or disorder.

Any modification in the RSL loop sequence of a serpin molecule can be made in the methods provided herein. Alignments of RSL sequences of exemplary wild-type serpins are set forth in Table 4 below. In the Table below, the numbers designating the P15 to P5' positions are with respect to a mature a 1'-antitrypsin molecule (corresponding to amino acids 367-387 of the sequence of amino acids set forth in SEQ ID NO:1). The identity of the RSL loop sequences are known to those of skill in the art and/or can be determined by alignments such as by alignment with serpins as set forth in Table 4 below.

the amino acid sequence PRFKII (SEQ ID NO: 503). Exemplary of such mutant AT3 molecules are set forth in any of SEQ ID NOS:497, 499, 500, and 502.

Alternatively, and if necessary, the modification in any one or more amino acid positions P4-P2' can be made one at a time, two at a time, three at a time, etc., and the resulting modified serpin can be separately tested in successive rounds of selection so as to optimize for proteases that exhibit substrate specificity and/or selectivity at each of the modified positions.

TABLE 4

RSL LOOP SEQUENCE ALIGNMENT*

| SERPIN | RSL loop sequence | SEQ ID NO |
|---|---|---|
| Manduca sexta serpin 1B | $_{343}P_{15}$ $P_{10}$ $P_4$ $P_1P_1$ $P_5'_{363}$ EGAEAAAANAFGIVPKSLILY | 397 |
| Manduca sexta serpin 1K | EGAEAAAANAFKITTYSFHFV | 398 |
| α1-antichymotrypsin | EGTEASAATAVKITLLSALVE | 399 |
| Antithrombin-III | EGSEAAASTAVVIAGRSLNPN | 400 |
| PAI-II | EGTEAAAGTGGVMTGRTGHGG | 401 |
| α1-antitrypsin | KGTEAAGAMFLEAIPMSIPPE | 402 |
| PAI-I | SGTVASSSTAVIVSARMAPEE | 403 |
| PAI-III | SGTRAAAATGTIFTFRSARLN | 404 |
| Ovalbumin | AGREVVGSAEAGVDAASVSEE | 405 |

*adapted from Ye et al. (2001) Nature Structural Biology 8: 979

Thus, amino acid sequences within the RSL loop of a serpin corresponding to any one or more of amino acids in the reactive site of a serpin (i.e. any one or more of amino acids corresponding to P15 to P5' positions such as set forth, for example, in Table 4 above) can be modified. Typically, amino acids that are part of the hinge region of the RSL loop sequence are not modified (i.e. amino acids corresponding to P15-P9 positions). In one example, one or more amino acid in the P1 and/or P1' position are modified corresponding to those amino acids that flank the scissile bond. In another example, any one or more amino acids corresponding to reactive site positions P4-P2' are modified. For example, the P4-P1' of PAI-1 is VSARM (SEQ ID NO:378), where cleavage occurs between the R (P1) and M (P1') amino acids. Modification of any or more of amino acids of the VSARM sequence can be made to modify the cleavage sequence of PAI-1 to select for proteases with altered specificity. Example 1 exemplifies modification of PAI-1 where the VSARM sequence in the reactive site loop is modified to be RRARM (SEQ ID NO:379). In another example, the reactive site loop the VSARM sequence can be modified to the known efficient peptide substrate PFGRS (SEQ ID NO:389). Exemplary of such mutant PAI-1 are set forth in SEQ ID NOS:610 and 611.

In another example, modifications can be made in the RSL of antithrombin III (AT3). For example, the P4-P1' of AT3 is IAGRSL (SEQ ID NO:478), where cleavage occurs between the R (P1) and S (P1') amino acids. Modification of any one or more of amino acids of the IAGRSL sequence can be made to modify the cleavage sequence of AT3 to select for proteases with altered specificity. Examples 6 and 7 exemplify modification of AT3 where the IAGRSL sequence in the reactive site loop is modified to be RRVRKE (SEQ ID NO:498). In another example, the IAGRSL amino acid sequence in the reactive site loop can be modified to SLGRKI (SEQ ID NO:479). Other modified AT3 polypeptides were made containing replacement of the IAGRSL amino acid sequence with the amino acid sequence SKGRSL (SEQ ID NO:501) or In most cases, amino acid residues that replace amino acid residues in the reactive site loop of a wild-type serpin, or analogous sequence in another protease trap, are chosen based on cleavage sequences in a desired target substrate. A target substrate protein is one that is normally involved in a pathology, where cleaving the target protein at a given substrate sequence serves as a treatment for the pathology (see e.g. U.S. patent publication No. US 2004/0146938, US2006/0024289, US2006/0002916, and provisional application Ser. No. 60/729,817). For example, the target protein can be one involved in rheumatoid arthritis (i.e. TNFR), sepsis (i.e. protein C), tumorigenicity (i.e. a growth factor receptor, such as a VEGFR), or inflammation (i.e. a complement protein). A target substrate also can be a viral protein such that upon cleavage of the viral protein the viruses would be unable to infect cells. Table 5 below sets forth exemplary target substrates.

TABLE 5

Exemplary Target Substrates

| Target | Indication | Molecule Class |
|---|---|---|
| IL-5/IL-5R | Asthma | Cytokine |
| IL-1/IL-1R | Asthma, inflammation, Rheumatic disorders | Cytokine |
| IL-13/IL-13R | Asthma | Cytokine |
| IL-12/IL-12R | Immunological disorders | Cytokine |
| IL-4/IL-4R | Asthma | Cytokine |
| TNF/TNFR | Asthma, Crohn's disease, HIV infection, inflammation, psoriasis, rheumatoid arthritis, inflammatory bowel disease | Cytokine |
| CCR5/CXCR4 | HIV infection | GPCR |

TABLE 5-continued

Exemplary Target Substrates

| Target | Indication | Molecule Class |
|---|---|---|
| gp120/gp41 | HIV infection | Fusion protein |
| CD4 | HIV infection | Immune Receptor |
| Hemaglutinin | Influenza infection | Fusion Protein |
| RSV fusion protein | RSV infection | Fusion Protein |
| B7/CD28 | Graft-v-host disorder, rheumatoid arthritis, transplant rejection, diabetes mellitus | Immune Receptor |
| IgE/IgER | Graft-v-host disorder, transplant rejection | Antibody receptor |
| CD2, CD3, CD4, CD40 | Graft-v-host disorder, transplant rejection, psoriasis | Immune Receptor |
| IL-2/IL-2R | Autoimmune disorders, graft-v-host disorders, rheumatoid arthritis | Cytokine |
| VEGF, FGF, EGF, TGF | Cancer | Growth Factor |
| HER2/Neu | Cancer (i.e. breast cancer) | Growth Factor Receptor |
| CCR1 | Multiple sclerosis | GPCR |
| CXCR3 | Multiple sclerosis, rheumatoid arthritis | GPCR |
| CCR2 | Atherosclerosis, rheumatoid arthritis | GPCR |
| Src | Cancer, osteoporosis | Kinase |
| Akt | Cancer | Kinase |
| Bcl-2 | Cancer | Protein-protein |
| BCR-Abl | Cancer | Kinase |
| GSK-3 | Diabetes | Kinase |
| Cdk-2/cdk-4 | Cancer | Kinase |
| EGFR | Lung, breast, bladder, prostate, colorectal, kidney, head & neck cancer | |
| VEGFR-1, VEGFR-2 | neck cancer | Growth Factor Receptor |
| Complement | Inflammatory diseases | Immune molecules |

Cleavage sites within target proteins are known or can be easily identified. Cleavage sites within target proteins are identified by the following criteria: 1) they are located on the exposed surface of the protein; 2) they are located in regions that are devoid of secondary structure (i.e. not in β sheets of helices), as determined by atomic structure of structure prediction algorithms (these regions tend to be loops on the surface of proteins or stalk on cell surface receptors); 3) they are located at sites that are likely to inactive (or activate) the protein, based on its known function. Cleavage sequences are e.g., four residues in length (i.e. P1-P4 positions) to match the extended substrate specificity of proteases, but can be longer or shorter. For example, the P4-P1 amino acid residues for a cleavage sequence in complement factor C2 is SLGR (SEQ ID NO:431), but also can be represented as the P4-P2' sequence of SLGRKI (SEQ ID NO:479), where cleavage occurs between the P1 and P1' position (i.e. between R/K). Hence, any one or more residues within a cleavage sequence, including any one or more of residues P4-P2', including P4-P1, can be introduced into a protease trap polypeptide, such as in the RSL of a serpin to generate a mutant protease trap polypeptide.

Cleavage sequences can be identified in a target substrate by any method known in the art (see e.g., published U.S. Application No. US 2004/0146938). In one example, cleavage of a target substrate is determined by incubating the target substrate with any protease known to cleave the substrate. Following incubation with the protease, the target protein can be separated by SDS-PAGE and degradative products can be identified by staining with a protein dye such as Coomassie Brilliant Blue. Proteolytic fragments can be sequenced to determine the identity of the cleavage sequences, for example, the 6 amino acid P4-P2' cleavage sequence, and in particular, the four amino acid P4-P1 cleavage sequence residues. Table 6 identifies cleavage sequences corresponding to positions P4-P1 for exemplary target substrates.

TABLE 6

Cleavage Sequence for Exemplary Target Substrates (P4-P1 residues)

| Target | Cleavage sequence |
|---|---|
| TNF-α | AEAK (406) |
| TNF-R1 | ENVK (407); GTED (408) |
| TNF-R2 | SPTR (409); VSTR (410); STSF (411) |
| HER-2 | KFPD (412); AEQR (413) |
| EGFR | KYAD (414); NGPK (415) |
| VEGFR-1 | SSAY (416); GTSD (417) |
| VEGFR-2 | AQEK (418); RIDY (419); VLKD (480); LVED (481); WFKD (482); RIYD (483); KVGR (484); RVRK (485); RKTK (486); KTKK (487); TKKR (488); RRVR (489) |
| C3 | REFK (420); GLAR (421); RLGR (422); AEGK (423); QHAR (424); LPSR (425); SLLR (426); LGLA (427); LSVV (428) |
| C4 | HRGR (429) |
| C2 | GATR (430); SLGR (431); VFAK (432) |

Hence, modification of an RSL of a serpin, or analogous sequence in other protease traps, can be modified to any desired or predetermined cleavage sequence of a target substrate. In one example, the selected cleavage sequence can be one that is a particularly efficient cleavage sequence of t-PA. Such a cleavage sequence is, for example, PFGRS (SEQ ID NO:389; see e.g., Ding et al. (1995) *PNAS,* 92:7627-7631). Thus, for example, a protease can be selected for that has an altered substrate specificity that is made to replicate the substrate specificity of t-PA. Since t-PA is an often used therapeutic for the treatment of fibrinolytic disorders, such a selected protease can be optimized to be an alternative t-PA therapeutic, while minimizing undesirable side effects often associated with t-PA therapies (i.e. excessive bleeding).

In another example, a cleavage sequence for a complement protein can be targeted as a predetermined or desired cleavage sequence for selection of a protease using the methods provided herein. A protease selected to have increased substrate specificity against any one or more complement proteins would be a therapeutic candidate for treatment of disorders and diseases associated with inflammation such as, but not limited to, autoimmune diseases, such as rheumatoid arthritis and lupus, cardiac disorders, and other inflammatory disorders such as sepsis and ischemia-reperfusion injury (see e.g., provisional application Ser. No. 60/729,817). Example 6 to Examples 15 exemplify selection of an MT-SP 1 protease against an AT3 serpin molecule modified by replacements of its native P4-P2' residues IAGRSL (SEQ ID NO:478) with a cleavage sequence of the C2 complement proteins (i.e. SLGRKI, SEQ ID NO:479). Modification or replacement of amino acid residues by the SLGRKI cleavage sequence, or intermediates thereof such as are described below, can be made in any protease trap polypeptide, such as any serpin polypeptide, for selection of any candidate protease as so desired.

In an additional example, a cleavage sequence can be selected in a VEGFR, such as in the stalk region of a VEGFR, such that the VEGFR is inactivated upon cleavage by a protease having specificity for the cleavage sequence. Examples of cleavage sequences in a VEGFR are described herein and set forth in related published U.S. application serial Nos.

US20060024289 and US20060002916. For example, the RSL of a serpin, or analogous sequence in other protease traps such as the "bait" region in alpha-2 macroglobulin, can be modified to have any one or more of amino acid positions P4-P2' replaced with the cleavage sequence of a VEGFR. In one example, amino acid residues in a native serpin can be modified to contain the P4-P1 positions corresponding to the RRVR (SEQ ID NO:489) cleavage sequence, or the entire P4-P2' sequence RRVRKE (SEQ ID NO:498). A protease selected against such a modified serpin would be a candidate to treat VEGFR-mediated disorders, such as for example, angiogenic disorders.

In some cases, in the methods provided herein, the modifications in any one or more of the P4-P2' positions of a serpin RSL, or analogous sequence in other protease traps, can be made in successive rounds to optimize for selection of proteases with a desired or predetermined substrate specificity. For example, both u-PA and t-PA proteases prefer small amino acids at the P2 position and very different amino acids in the P3 and P4 positions. Thus, modified serpins can be generated that are intermediates for the final target cleavage sequence, where a first intermediate is generated by modification of only the P3 and P4 positions to select for proteases that exhibit specificity at the P3 and P4 positions. The selected protease or proteases can then be used as a template for the generation of a new combinatorial library against a new serpin molecule modified to additionally have the P2 position changed.

Thus, in selection, for example, of a u-PA protease, or variant thereof, that exhibits increased substrate specificity for the VEGFR cleavage sequence RRVR(SEQ ID NO: 489), the first round of selection can be made against an intermediate modified protease trap polypeptide, such as a serpin, where only the P3 and P4 positions are changed as compared to the native sequence at those positions. For example, where the native P4-P1' amino acids in the RSL loop of the serpin PAI-1 are VSARM (SEQ ID NO: 378), a modified intermediate PAI-1 can be made by replacement of only the P4 and P3 VEGFR cleavage sequence, to yield the intermediate serpin molecule containing RRARM (SEQ ID NO:379) in the P4-P1' positions. Subsequent rounds of protease selection can be made against a PAI-1 serpin that has additionally been modified at the P2 position.

Protease traps, including serpins, can be modified using any method known in the art for modification of proteins. Such methods include site-directed mutagenesis, including single or multi-sited directed mutagenesis. Likewise, expression and purification of protease-trap polypeptides, including variant protease-trap polypeptides can be performed using methods standard in the art for expression and purification of polypeptides. Any host cell system can be used for expression, including, but not limited to, mammalian cells, bacterial cells or insect cells. Further, the protease trap polypeptides can be modified further to include additional sequences that aid in the identification and purification of the protease trap polypeptide. For example, epitope tags, such as but not limited to, His tags or Flag tags, can be added to aid in the affinity purification of the polypeptide. In some examples, protease trap polypeptides are directly biotinylated to aid in capture and/or purification. An exemplary method for biotinylating a protease-trap polypeptide is described in Example 16.

Assays, such as assays for biological function of a serpin molecule or other protease trap are known in the art and can be used to assess the activity of a modified protease trap as an inhibitor in the methods provided herein. Such assays are dependent on the protease trap polypeptide modified for use in the methods herein. Exemplary of such assays for PAI-1 include, for example, active site titration against standard trypsin or titration of standard trypsin such as are exemplified in Example 1. Also exemplary of such assays are protease inhibition assays, which are known in the art, whereby the ability of the protease trap to inhibit the cleavage of a fluorogenic substrate by an active protease is used as a readout for protease trap activity. Exemplary of a protease inhibition assay is a matriptase (MT-S P1) inhibition assay. In one example of such an assay, the protease trap is a serpin. In a specific example, the serpin is AT3 or a variant AT3 protein made according to the methods provided herein, the fluorogenic substrate is RQAR-ACC. Cleavage of the substrate is measured, for example, as exemplified in Example 14A. Thrombin inhibition assays also can be used to assess the activity of AT3, or modified AT3. Similar assays can be designed or are known to one of skill in the art depending on the cognate protease for which a protease trap polypeptide, or variant thereof, normally interacts. Further, it is expected and often is the case that a modified protease trap polypeptide will have reduced activity as compared to a wild-type protease trap polypeptide in normal assays of protease trap activity or function.

D. PROTEASES

In the methods provided herein, candidate proteases are selected for that exhibit an altered substrate specificity, typically for a predetermined or desired substrate. Collections of proteases, mutant protease, or catalytically active portions thereof are contacted with a protease trap polypeptide, such as any provided herein including, for example, serpins or modified serpins, to select for proteases with altered substrate specificity. The protease collections can be provided on a solid support or in a homogenous mixture such as in solution or suspension. The selected proteases can be isolated as stable complexes with the protease trap polypeptide, and can be identified. Selected proteases display increased catalytic efficiency and reactivity against the desired or predetermined target substrate, and are thereby candidates for use as therapeutics, such as in any disease or disorder for which the target substrate is involved.

1. Candidate Proteases

In the method provided herein, proteases are selected for that have an altered and/or increased specificity for a desired substrate that is involved in a disease or disorder. Generally, proteases are highly specific proteins that hydrolyze target substrates while leaving others intact. For the cleavage of natural substrates, proteases exhibit a high degree of selectivity such that substrate cleavage is favored, whereas non-substrate cleavage is disfavored (Coombs et al. (1996) *J. Biol. Chem.*, 271: 4461-4467). Selecting for proteases with an altered specificity and selectivity for a desired target substrate would enable the use of proteases as therapeutics to selectively activate or inactivate proteins to reduce, ameliorate, or prevent a disease or disorder. Target proteases used in the protease trap selection method provided herein can be any known class of protease capable of peptide bond hydrolysis for which the protease trap interacts. Typically, for serpins, such proteases are generally serine or cysteine proteases for which serpins react with to form a covalent intermediate complex. Exemplary of serine and cysteine proteases are any protease set forth in Table 7 below. Typically, a library of modified proteases are used in the methods provided herein to select for a protease variant that exhibits an increased specificity or selectivity for a target protease trap, or variant thereof, such as a serpin, or variant thereof.

Exemplary proteases that can be used, and/or modified to be used, in the selection method provided herein are described, and include truncated polypeptides thereof that include a catalytically active portion. Exemplary candidate proteases are listed in Table 7 and described herein (see e.g., www.merops.sanger.ac.uk). The sequence identifiers (SEQ ID NO) for the nucleotide sequence and encoded amino acid precursor sequence for each of the exemplary candidate proteases is depicted in the Table. The encoded amino acids corresponding to the signal peptide or propeptide sequence to yield a mature protein also are noted in the Table. In addition, amino acids designating the protease domain (i.e. peptidase unit) also are noted, as are the active site residues that make up, for example, the catalytic triad of the respective protease. Since interactions are dynamic, amino acid positions noted are for reference and exemplification. The noted positions reflects a range of loci that vary by 2, 3, 4, 5 or more amino acids. Variations also exist among allelic variants and species variants. Those of skill in the art can identify corresponding sequences by visual comparison or other comparisons including readily available algorithms and software.

Candidate proteases for selection typically are wild-type or modified or variant forms of a wildtype candidate protease, or catalytically active portion thereof, including allelic variant and isoforms of any one protein. A candidate protease can be produced or isolated by any method known in the art including isolation from natural sources, isolation of recombinantly produced proteins in cells, tissues and organisms, and by recombinant methods and by methods including in silico steps, synthetic methods and any methods known to those of skill in the art. Modification of a candidate protease for selection can be by any method known to one of skill in the art, such as any method described herein below.

TABLE 7

Exemplary Candidate Proteases

| Protease Type | Merops Code | Name | Nt. ACC. NO: | Nt. SEQ ID NO: | A.A. ACC. NO: | A.A. SEQ ID NO: | Signal/ propeptide sequence | Peptidase unit (active site residues) |
|---|---|---|---|---|---|---|---|---|
| Serine Protease: Chymotrypsin family | S01.010 | granzyme B, human-type | M17016 | 39 | P10144 | 40 | 1-18/19-20 | 21-247 (64, 108, 203) |
| | S01.011 | Testisin | NM_006799 (v1) | 41 | NP_006790 | 42 | 1-19/20-41 | 42-288 (82, 137, 238) |
| | | | NM_144956 (v2) | 43 | NP_659205 | 44 | | |
| | | | NM_144957 (v3) | 45 | NP_659206 | 46 | | |
| | S01.015 | trypstase beta 1 (*Homo sapiens*) (III) | NM_003294 | 47 | NP_003285 | 48 | 1-18/19-30 | 31-274 (74, 121, 224) |
| | S01.017 | kallikrein hk5 | NM_012427 | 49 | NP_036559 | 50 | 1-22/ | 67-292 (108, 153, 245) |
| | S01.019 | Corin | NM_006587 | 51 | NP_006578 | 52 | | 802-1037 (843, 892, 985) |
| | S01.020 | kallikrein 12 | NM_019598 (v1) | 53 | NP_062544 | 54 | 1-17/ | 22-248 (843, 892, 985) |
| | | | NM_145894 (v2) | 55 | NP_665901 | 56 | | |
| | | | NM_145895 (v3) | 57 | NP_665902 | 58 | | |
| | S01.021 | DESC1 oritease | AF064819 | 59 | AAF04328 | 60 | | 191-422 (231, 276, 372) |
| | S01.028 | tryptase gamma 1 | NM_012467 | 61 | NP_036599 | 62 | 1-19/ | 38-272 (78, 125, 222) |
| | S01.029 | kallikrein hK14 | NM_022046 | 63 | Q9P0G3 | 64 | 1-18/19-24 | 25-249 (67, 111, 204) |
| | S01.033 | hyaluronan-binding serine protease (HGF activator-like protein) | NM_004132 | 65 | NP_004123 | 66 | 1-23/ | 314-557 (362, 411, 509) |
| | S01.034 | transmembreane protease, serine 4 | NM_019894 NM_183247 | 67 69 | NP_063947 NP_899070 | 68 70 | | 205-436 (245, 290, 387) |
| | S01.054 | tryptase delta 1 (*Homo sapiens*) | NM_012217 | 71 | Q9BZJ3 | 72 | 1-18/19-30 | 31-235 (74, 121, 224) |
| | S01.074 | Marapsin | NM_031948 | 73 | NP_114154 | 74 | 1-22/23-34 | 35-279 (75, 124, 229) |
| | S01.075 | Tryptase homologue 2 (*Homo sapiens*) | BC036846 | 75 | AAN04055 | 76 | | 37-281 (77, 126, 231) |
| | S01.076 | Tryptase homologue 3 | Putative Only | 77 | | 78 | | 67-304 (107, 213, |

TABLE 7-continued

Exemplary Candidate Proteases

| Protease Type | Merops Code | Name | Nt. ACC. NO: | Nt. SEQ ID NO: | A.A. ACC. NO: | A.A. SEQ ID NO: | Signal/ propeptide sequence | Peptidase unit (active site residues) |
|---|---|---|---|---|---|---|---|---|
| | | (Homo sapiens) | AC005570 (Cosmid 407D8) | | | | | 259) |
| | S01.079 | transmembrane protease, serine 3 | NM_024022 (vA) | 79 | NP_076927 | 80 | | 217-451 (257, 304, 401) |
| | | | NM_032401 (vB) | 81 | NP_115777 | 82 | | |
| | | | NM_032404 (vC) | 83 | NP_115780 | 84 | | |
| | | | NM_032405 (vD) | 85 | NP_115781 | 86 | | |
| | S01.081 | kallikrein hK15 (Homo sapiens) | NM_023006 (v1) | 87 | NP_075382 | 88 | 1-16/17-21 | 22-256 (62, 106, 209) |
| | | | NM_138563 (v2) | 89 | NP_612630 | 90 | | |
| | | | NM_138564 (v3) | 91 | NP_612631 | 92 | | |
| | | | NM_017509 (v4) | 93 | NP_059979 | 94 | | |
| | S01.085 | Mername-AA031 peptidase (deduced from ESTs by MEROPS) | BC035384 | 95 | AAH35384 | 96 | | 1-241 (56, 101, 195) |
| | S01.087 | membrane-type mosaic serine protease | AB048796 | 97 | BAB39741 | 98 | | 321-556 (361, 409, 506) |
| | S01.088 | mername-AA038 peptidase | Putative Only AL136097 (RP11-62C3 clone) | | CAC12709 | 99 | | 10-142 (50, 101) |
| | S01.098 | mername-AA128 peptidase (deduced from ESTs by MEROPS) | Putative Only BC041609 | 100 | AAH41609 | 101 | | 33-202 (50, 152) |
| | S01.127 | cationic trypsin (Homo sapiens-type 1) (cationic) | NM_002769 | 102 | NP_002760 | 103 | 1-15/16-23 | 24-246 (63, 107, 200) |
| | S01.131 | Neutrophils elastase | NM_001972 | 104 | NP_001963 | 105 | 1-27/28-29 | 30-249 (70, 117, 202) |
| | S01.132 | mannan-binding lectin-associated serine protease-3 | AF284421 | 106 | AAK84071 | 107 | 1-19/ | 449-710 (497, 553, 664) |
| | S01.133 | cathepsin G | NM_001911 | 108 | NP_001902 | 109 | 1-18/19-20 | 21-245 (64, 108, 201) |
| | S01.134 | myeloblastin (proteinase 3) | NM_002777 | 110 | NP_002768 | 111 | 1-25/26-27 | 28-250 (71, 118, 203) |
| | S01.135 | granzyme A (CTLA3) | NM_006144 | 112 | NP_006135 | 113 | 1-26/27-28 | 29-261 (69, 114, 212) |
| | S01.139 | granzyme M | NM_005317 | 114 | NP_005308 | 115 | 1-23/24-25 | 26-256 (66, 111, 207) |
| | S01.140 | chymase (human-type) | NM_001836 | 116 | NP_001827 | 117 | 1-19/21-21 | 22-247 (66, 110, 203) |
| | S01.143 | tryptase alpha (1) | NM_003294 | 118 | NP_003285 | 119 | 1-18/19-30 | 31-274 (74, 121, 224) |
| | S01.146 | granzyme K | NM_002104 | 120 | NP_002095 | 121 | 1-24/26-26 | 27-261 (67, 116, 214) |

TABLE 7-continued

Exemplary Candidate Proteases

| Protease Type | Merops Code | Name | Nt. ACC. NO: | Nt. SEQ ID NO: | A.A. ACC. NO: | A.A. SEQ ID NO: | Signal/ propeptide sequence | Peptidase unit (active site residues) |
|---|---|---|---|---|---|---|---|---|
| | S01.147 | granzyme H (CTLA1) | NM_033423 | 122 | NP_219491 | 123 | 1-18/19-20 | 21-246 (64, 108, 202) |
| | S01.152 | chymotrypsin B | M24400 | 124 | P17538 | 125 | 1-18 | 34-263 (75, 120, 213) |
| | S01.153 | pancreatic elastase | NM_001971 | 126 | NP_001962 | 127 | 1-8/9-18 | 19-256 (63, 111, 206) |
| | S01.154 | pancreatic endopeptidase E (A) | NM_005747 | 128 | NP_005738 | 129 | 1-15/16-28 | 29-270 (73, 123, 217) |
| | S01.155 | pancreatic elastase II (IIA) | M16652 | 130 | AAA52380 | 131 | 1-16/7-28 | 29-269 (73, 121, 216) |
| | S01.156 | Enteropeptidase | NM_002772 | 132 | NP_002763 | 133 | | 785-1019 (825, 876, 971) |
| | S01.157 | chymotrypsin C | NM_007272 | 134 | NP_009203 | 135 | 1-16/17-29 | 30-268 (74, 121, 216) |
| | S01.159 | Prostasin | NM_002773 | 136 | NP_002764 | 137 | 1-29/30-32 | 45-288 (85, 134, 238) |
| | S01.160 | kallikrein 1 | NM_002257 | 138 | NP_002248 | 139 | 1-18/19-24 | 25-261 (65, 120, 214) |
| | SO1.161 | kallikrein hK2 (*Homo sapiens*) | NM_005551 (v1) | 140 | NP_005542 | 141 | 1-18/19-24 | 25-260 (65, 120, 213) |
| | | | NM_001002231 (v2) | 142 | NP_001002231 | 143 | | |
| | | | NM_001002232 (v3) | 144 | NP_001002232 | 145 | | |
| | S01.162 | kallikrein 3 | NM_001648 (v1) | 146 | NP_001639 (v1) | 147 | 1-17/18-24 | 25-260 (65, 120, 213) |
| | | | NM_001030047 (v3) | 148 | NP_001025218 (v3) | 149 | | |
| | | | NM_001030048 (v4) | 150 | NP_001025219 (v4) | 151 | | |
| | | | NM_001030049 (v5) | 152 | NP_001025220 (v5) | 153 | | |
| | | | NM_001030050 (v6) | 154 | NP_001025221 (v6) | 155 | | |
| | S01.174 | Mesotrypsin | NM_002771 | 156 | NP_002762 | 157 | 1-24/ | 24-246 (63, 107, 200) |
| | S01.205 | pancreatic endopeptidase E form B (B) | NM_007352 | 158 | NP_031378 | 159 | 1-15/16-28 | 29-270 (73, 123, 217) |
| | S01.206 | pancreatic elastase II form B (*Homos sapiens*) (IIB) | NM_015849 | 160 | NP_056933 | 161 | 1-16/17-28 | 29-269 (73, 121, 216) |
| | S01.211 | coagulation factor XIIa | NM_000505 | 162 | NP_000496 | 163 | 1-19/ | 373-615 (412, 461, 563) |
| | S01.212 | plasma kallikrein (KLK3) | NM_000892 | 164 | NP_000883 | 165 | 1-19/ | 391-628 (434, 483, 578) |
| | S01.213 | coagulation factor XIa (HAF) | NM_000128 (v1) | 166 | NP_000119 (v1) | 167 | 1-18/ | 388-625 (431, 480, 575) |
| | | | NM_019559 (v2) | 168 | NP_062505 (v2) | 169 | | |
| | S01.214 | coagulation factor IXa | NM_000133 | 170 | NP_000124 | 171 | 1-28/29-46 | 227-461 (267, 315, 411) |
| | S01.215 | coagulation factor VIIa | NM_000131 (v1) | 172 | NP_000122 (v1) | 173 | 1-20/21-60 | 213-454 (253, 302, 404) |
| | | | NM_019616 (v2) | 174 | NP_062562 (v2) | 175 | | |

TABLE 7-continued

Exemplary Candidate Proteases

| Protease Type | Merops Code | Name | Nt. ACC. NO: | Nt. SEQ ID NO: | A.A. ACC. NO: | A.A. SEQ ID NO: | Signal/ propeptide sequence | Peptidase unit (active site residues) |
|---|---|---|---|---|---|---|---|---|
| | S01.216 | coagulation factor Xa | NM_000504 | 176 | NP_000495 | 177 | 1-31/32-40 | 235-469 (276, 322, 419) |
| | S01.217 | Thrombin | NM_000506 | 178 | NP_000497 | 179 | 1-24/25-43 | 364-620 (406, 462, 568) |
| | S01.218 | protein C (activated) | NM_000312 | 180 | NP_000303 | 181 | 1-32/33-42 | 212-452 (253, 299, 402) |
| | S01.223 | Acrosin | NM_001097 | 182 | NP_001088 | 183 | 1-19 | 43-292 (88, 142, 240) |
| | S01.224 | Hepsin | NM_182983 (v1) | 184 | NP_892028 | 185 | | 163-407 (203, 257, 353) |
| | | | NM_002151 (v2) | 186 | NP_002142 | 187 | | |
| | S01.228 | hepatocyte growth factor activator (HGFA) | NM_001528 | 188 | NP_001519 | 189 | 1-35/36-372 | 408-648 (447, 497, 598) |
| | S01.231 | u-plasminogen activator (uPA) | NM_002658 | 190 | NP_002649 | 191 | 1-20/ | 179-426 (224, 275, 376) |
| | S01.232 | t-plasminogen activator (tPA) | NM_000930 (v1) | 192 | NP_000921 (v1) | 193 | 1-23/24-32 and 33-35 | 311-562 (357, 406, 513) |
| | | | NM_000931 (v2) | 194 | NP_000922 (v2) | 195 | | |
| | | | NM_033011 (v3) | 196 | NP_127509 (v3) | 197 | | |
| | S01.233 | Plasmin | NM_000301 | 198 | NP_000292 | 199 | 1-19/20-97 | 581-810 (622, 665, 760) |
| | S01.236 | Neurosin | NM_002774 (vA) | 200 | NP_002765 | 201 | 1-16/17-21 | 22-244 (62, 106, 197) |
| | | | NM_001012964 (vB) | 202 | NP_001012982 | 203 | | |
| | | | NM_001012965 (vC) | 204 | NP_001012983 | 205 | | |
| | | | NM_001012966 (vD) | 206 | NP_001012984 | 207 | | |
| | S01.237 | Neurotrypsin | NM_003619 | 208 | NP_003610 | 209 | 1-20/ | 631-875 (676, 726, 825) |
| | S01.242 | tryptase beta 2 (*Homo sapiens*) (I) | NM_024164 | 210 | NP_077078 | 211 | 1-30/ | 31-268 |
| | S01.244 | Neuropsin | NM_007196 (v1) | 212 | NP_009127 (v1) | 213 | 1-28/29-32 | 33-258 (73, 120, 212) |
| | | | NM_144505 (v2) | 214 | NP_653088 (v2) | 215 | | |
| | | | NM_144506 (v3) | 216 | NP_653089 (v3) | 217 | | |
| | | | NM_144507 (v4) | 218 | NP_653090 (v4) | 219 | | |
| | S01.246 | kallikrein hK10 (*Homo sapiens*) | NM_002776 (v1) | 220 | NP_002767 | 221 | 1-30/ | 35-276 (86, 137, 229) |
| | | | NM_145888 (v2) | 222 | NP_665895 | 223 | | |
| | S01.247 | Epitheliasin | NM_005656 | 224 | NP_005647 | 225 | | 256-491 (296, 345, 441) |
| | S01.251 | Prostase | NM_004917 | 226 | NP_004908 | 227 | 1-26/27-30 | 31-254 (71, 116, 207) |
| | S01.252 | Brain serine proteinase 2 | NM_022119 | 228 | NP_071402 | 229 | 1-32 | 50-292 (90, 141, 242) |
| | S01.256 | Chymopasin | NM_001907 | 230 | NP_001898 | 231 | 1-18/19-33 | 34-264 (75, 121, 214) |
| | S01.257 | kallikrein 11 | NM_006853 (v1) | 232 | NP_006844 (v1) | 233 | 1-50/51-53 | 22-250 (62, 110, |

TABLE 7-continued

Exemplary Candidate Proteases

| Protease Type | Merops Code | Name | Nt. ACC. NO: | Nt. SEQ ID NO: | A.A. ACC. NO: | A.A. SEQ ID NO: | Signal/ propeptide sequence | Peptidase unit (active site residues) |
|---|---|---|---|---|---|---|---|---|
| | | | NM_144947 (v2) | 234 | NP_659196 (v2) | 235 | | 203) |
| | S01.258 | anionic trypsin (*Homo sapiens*) (II) (TRY2, TRY8, TRYP2) | NM_002770 | 236 | NP_002761 | 237 | 1-15/16-23 | 24-246 (63, 107, 200) |
| | S01.291 | LOC144757 peptidase (*Homo sapiens*) | Putative, BC048112 | 238 | AAH48112 | 239 | | 78-319 (122, 171, 268) |
| | S01.292 | Mername-AA169 peptidase | BN000133 | 240 | CAD67985 | 241 | 1-19 | 175-406 (215, 260, 356) |
| | S01.294 | Mername-AA171 peptidase | Putative No DNA | | | 242 | | |
| | S01.298 | Mername-AA174 peptidase (TRY6) | Putative no DNA seq | | AAC80208 | 243 | | 24-246 (63, 107, 200) |
| | S01.299 | Mername-AA175 peptidase | NM_198464 | 244 | NP_940866 | 245 | | 68-302 (108, 156, 250) |
| | S01.300 | stratum corneum chymotryptic enzyme (SCCE) | NM_005046 (v1) NM_139277 (v2) | 246 248 | NP_005037 NP_644806 | 247 249 | 1-22/23-29 | 30-250 (70, 112, 205) |
| | S01.301 | trypsin-like enzyme, respiratory (Transmembrane protease, serine 11D) | NM_004262 | 250 | NP_004253 | 251 | | 187-471 (227, 272, 368) |
| | S01.302 | Matripase (MTSP1) | AF118224 | 252 | AAD42765 | 253 | | 615-855 (656, 711, 805) |
| | S01.306 | kallikrein hK13 | NM_015596 | 254 | NP_056411 | 255 | 1-16/ | 36-263 (76, 124, 218) |
| | S01.307 | kallikrein hK9 (human numbering) | NM_012315 | 256 | NP_036447 | 257 | 1-15/ | 23-250 (63, 111, 204) |
| | S01.308 | Mername-AA035 peptidase | NM_153609 | 258 | NP_705837 | 259 | | 49-283 (89, 140, 234) |
| | S01.309 | umbilical vein proteinase | NM_007173 | 260 | NP_009104 | 261 | 1-23/ | 95-383 (175, 246, 316) |
| | S01.311 | LCLP proteinase (LCLP (N-terminus)) | Peptide fragment No DNA | | P34168 | 262 | | 1-26 (0) |
| | S01.313 | Spinesin | NM_030770 | 263 | NP_110397 | 264 | | 218-455 (258, 308, 405) |
| | S01.318 | Mername-AA178 peptidase | NM_183062 | 265 | NP_898885 | 266 | 1-33/ | 53-288 (93, 143, 238) |
| | S01.320 | Mername-AA180 peptidase | BN000120 | 267 | CAD66452 | 268 | 1-23/ | 52-301 (92, 142, 240) |
| | S01.322 | Mername-AA182 peptidase | BN000128 | 269 | CAD67579 | 270 | 1-17/ | 8-298 (87, 139, 237) |
| | S01.414 | Mername-AA122 peptidase (deduced from ESTs by MEROPS) | Putative AK075142 | 271 | BAC11431 | 272 | | 1-177 (12, 64, 168) |

TABLE 7-continued

Exemplary Candidate Proteases

| Protease Type | Merops Code | Name | Nt. ACC. NO: | Nt. SEQ ID NO: | A.A. ACC. NO: | A.A. SEQ ID NO: | Signal/ propeptide sequence | Peptidase unit (active site residues) |
|---|---|---|---|---|---|---|---|---|
| Cysteine protease: Papain family | C01.032 | Cathepsin L | X12451 | 273 | P07711 | 274 | 1-17/18-113 | 113-333 (132, 138, 276, 300) |
| | C01.009 | Cathepsin V | U13665 | 275 | O60911 | 276 | 1-17/18-113 | 114-334 (132, 138, 277, 301) |
| | C01.036 | Cathepsin K | S93414 | 277 | P43235 | 278 | 1-15/16-114 | 115-329 (133, 139, 276, 296) |
| | C01.034 | Cathepsin S | AJ007331 | 279 | P25774 | 280 | 1-16/17-114 | 115-331 (133, 139, 278, 298) |
| | C01.018 | Cathepsin F | M14221 | 281 | Q9UBX1 | 282 | 1-19/20-270 | 271-484 (289, 295, 431, 451) |
| | C01.060 | Cathepsin B | M15203 | 283 | P07858 | 284 | 1-17/18-79 | 80-331 (102, 108, 278, 298) |
| | C01.001 | Papain | M84342 | 285 | P00784 | 286 | 1-18/19-133 | 135-342 (158, 292, 308) |
| | C01.075 | Cruzain (Cruzapain) | Y14734 | 287 | P25779 | 288 | 123-467/ | 124-334 (147, 284, 304, |
| Serine Protease: subtilisin family | S08.001 | Subtilisin Carlsberg precursor | X03341 | 290 | P00780 | 289 | 1-29/30-105 | 111-370 (137, 168, 325) |
| | S08.002 | Subtilisin (Alkaline mesentericopeptidase) | | | P07518 | 291 | | 6-266 (32, 64, 221) |
| | S08.003 | Subtilisin Savinase (Alkaline protease) | | | P29600 | 292 | | 6-260 (32, 62, 215) |
| | S08.007 | Thermitase | | | P04072 | 293 | | 13-264 (38, 71, 225) |
| | S08.009 | Thermophilic serine proteinase precursor (Ak.1 protease) | L29506 | 295 | Q45670 | 294 | 1-24/25-121 | 134-391 (160, 193, 347) |
| | S08.020 | C5a peptidase precursor | J05229 | 297 | P15926 | 296 | 1-31/ | 120-339, 458-560 (130, 193, 512) |
| | S08.021 | fervidolysin | AY035311 | 299 | AAK61552 | 298 | | 164-457 |
| | S08.035 | Subtilisin J precursor | M64743 | 301 | P29142 | 300 | 1-29/30-106 | 112-372 (138, 170, 327) |
| | S08.036 | Subtilisin E precursor | K01988 | 303 | P04189 | 302 | 1-23/24-106 | 112-372 (138, 170, 327) |
| | S08.037 | Subtilisin DY | | | P00781 | 304 | | 6-257 (32, 63, 220) |
| | S08.054 | Proteinase K precursor (Endopeptidase K) | X14689 | 306 | P06873 | 305 | 1-15/16-105 | 134-373 (144, 174, 329) |
| | S08.050 | Alkaline serine exoprotease A precursor | M25499 | 308 | P16588 | 307 | 1-21/22-141 | 155-412 (180, 213, 363) |
| | S08.060 | Epidermin leader peptide-processing serine protease epiP precursor | X62386 | 310 | P30199 | 309 | 1-23/24-? | 123-451 (149, 194, 402) |
| | S08.063 | Membrane-bound transcription factor site 1 | AF078105 | 312 | Q9Z2A8 | 311 | 1-14/18-186 | 179-473 (218, 249, 338, 414) |

TABLE 7-continued

Exemplary Candidate Proteases

| Protease Type | Merops Code | Name | Nt. ACC. NO: | Nt. SEQ ID NO: | A.A. ACC. NO: | A.A. SEQ ID NO: | Signal/ propeptide sequence | Peptidase unit (active site residues) |
|---|---|---|---|---|---|---|---|---|
| | | protease precursor (Site-1 protease, Subtilisin/kexin-isozyme 1, SKI-1) | | | | | | |
| | S08.066 | Alkaline proteinase precursor (ALP) | M87516 | 314 | Q03420 | 313 | 1-20/21-120 | 121-409 (161, 192, 353) |
| | S08.094 | Extracellular serine protease precursor | M13469 | 316 | P09489 | 315 | 1-27/ | 50-389 (76, 112, 341) |
| | S08.090 | Tripeptidyl-peptidase II (TPP-II) | AF035251 | 318 | Q9V6K1 | 317 | | 5-509 (131, 359, 549) |
| | S08.114 | Minor extracellular protease vpr precursor | M76590 | 320 | P29141 | 319 | 1-28/29-160 | 163-365, 487-586 (189, 233, 534) |
| | S08.116 | PIII-type proteinase precursor (Lactocepin) | J04962 | 322 | P15292 | 321 | 1-33/34-187 | 190-379, 584-628 (217, 281, 620) |
| | S08.048 | Furin-like protease 1, isoform 1-CRR precursor | M81431 | 324 | P30430 | 323 | 1-?/?-309 | 376-646 (372, 413, 587) |
| | S08.070 | Kexin precursor (KEX2 protease) (Kex2-like endoprotease 1, dKLIP-1) | M22870 | 326 | P13134 | 325 | 1-19/20-109 and 110-113 | 149-445 (175, 213, 385) |
| | S08.071 | Furin precursor (PACE) | X17094 | 328 | P09958 | 327 | 1-24/25-107 | 131-421 (153, 194, 295, 368) |
| | S08.075 | Subtilisin/kexin-like protease PACE4 (Proprotein convertase subtilisin/kexin type 6 precursor) | M80482 | 330 | P29122 | 329 | 1-63/64-149 | 182-473 (205, 246, 347, 420) |
| | S08.079 | Calcium-dependent protease precursor (Trypsin) | X56955 | 332 | P23916 | 331 | | 254-521 (233, 270, 466) |
| Cysteine protease: caspase family | C14.001 | Caspase-1 precursor (Interleukin-1 beta convertase, IL-1BC) | U14647 | 334 | P43527 | 333 | /1-118 | 120-404 236, 284) |
| | C14.002 | Cell death protein 3 precursor | L29052 | 336 | P42573 | 335 | | 235-495 (315, 358) |
| | C14.003 | Caspase-3 precursor (Apopain, Cysteine protease) | U13737 | 338 | P42574 | 337 | /1-9 | 10-277 (121, 163) |
| | C14.004 | Caspase-7 precursor (ICE-like apoptotic protease 3, Apoptotic protease Mch-3) | U39613 | 340 | P55210 | 339 | /1-23 | 29-303 (144, 186) |
| | C14.005 | Caspase-6 precursor | U20536 | 342 | P55212 | 341 | /1-23 | 24-292 (121, 163) |

TABLE 7-continued

Exemplary Candidate Proteases

| Protease Type | Merops Code | Name | Nt. ACC. NO: | Nt. SEQ ID NO: | A.A. ACC. NO: | A.A. SEQ ID NO: | Signal/ propeptide sequence | Peptidase unit (active site residues) |
|---|---|---|---|---|---|---|---|---|
| | C14.006 | (Apoptotic protease Mch-2) Caspase-2 precursor (ICH-1 protease, NEDD2 protein) | D28492 | 344 | P29594 | 343 | /1-169 | 170-432 (277, 320) |
| | C14.007 | Caspase-4 precursor (ICH-2 protease, TX protease) | Z48810 | 346 | P49662 | 345 | /1-80 | 93-377 (210, 258) |
| | C14.008 | Caspase-5 precursor (ICH-3 protease, TY protease, ICE(rel)-III) | U28015 | 348 | P51878 | 347 | /1-120 | 134-418 (251, 299) |
| | C14.009 | Caspase-8 precursor (FADD-like ICE, ICE-like apoptotic protease 5) | X98172 | 350 | Q14790 | 349 | /1-216 | 193-479 (317, 360) |
| | C14.010 | Caspase-9 precursor (ICE-LAP6, Apoptotic protease Mch-6 | U56390 | 352 | P55211 | 351 | | 117-416 (237, 287) |
| | C14.011 | Caspase-10 precursor | U60519 | 354 | Q92851 | 353 | /1-219 | 243-514 (358, 401) |
| | C14.012 | Caspase-11 (Caspase-4 precursor) | U59463 | 356 | P70343 | 355 | /1-80 | 89-373 (206, 254) |
| | C14.013 | Caspase-12 precursor | Y13090 | 358 | O08736 | 357 | | 133-419 (250, 298) |
| | C14.015 | Caspase precursor (insect) (drICE) | Y12261 | 360 | O01382 | 359 | /1-28 | (169, 211) |
| | C14.016 | Caspase-1 precursor (insect) | AF001464 | 362 | O02002 | 361 | /1-33 | (154, 196) |
| | C14.017 | Caspase-13 precursor | AF078533 | 364 | O75601 | 363 | | (210, 258) |
| | C14.018 | Caspase-14 precursor | AF097874 | 366 | P31944 | 365 | | 1-242 (89, 132) |
| | C14.019 | Caspase Nc precursor (NEDD2-like caspase DRONC) | AF104357 | 368 | Q9XYF4 | 367 | /1-134 | (271, 318) |
| | C14.026 | MALT lymphoma translocation protein 1 paracaspase (paracaspase) | AF130356 | 370 | Q9UDY8 | 369 | | 337-523 (415, 464) |
| | C14.971 | CASP8 and FADD-like apoptosis regulator precursor (c-FLIP) | U85059 | 372 | O15519 | 371 | | 260-433 (315, 363) | a. Classes of Proteases

Proteases (also referred to as proteinases or peptidases) are protein-degrading enzymes that recognize sequences of amino acids or a polypeptide substrate within a target protein. Upon recognition of the substrate sequence of amino acids, proteases catalyze the hydrolysis or cleavage of a peptide bond within a target protein. Such hydrolysis of a target protein, depending on the location of the peptide bond within the context of the full-length sequence of the target sequence, can inactivate, or in some instances activate, a target.

Proteases are classified based on the way they attack the protein, either exo- or endo-proteases. Proteinases or endopeptidases attack inside the protein to produce large peptides. Peptidases or exopeptidases attack ends or fragments of protein to produce small peptides and amino acids. The peptidases are classified on their action pattern: aminopeptidase cleaves amino acids from the amino end: carboxypeptidase cleaves amino acids from the carboxyl end, dipeptidyl peptidase cleaves two amino acids; dipeptidase splits a dipeptide, and tripeptidase cleaves an amino acid from a tripeptide. Most proteases are small from 21,000 to 45,000 Daltons. Many proteases are synthesized and secreted as inactive forms called zymogens and subsequently activated by proteolysis. This changes the architecture of the active site of the enzyme.

Several distinct types of catalytic mechanisms are used by proteases (Barret et al. (1994) *Meth. Enzymol.* 244:18-61; Barret et al. (1994) *Meth. Enzymol* 244:461-486; Barret et al. (1994) *Meth. Enzymol.* 248:105-120; Barret et al. (1994) *Meth. Enzymol.* 248:183-228). Based on their catalytic mechanism, the carboxypeptidases are subdivided into serine-, metallo and cysteine-type carboxypeptidases and the endopeptidases are the serine-, cysteine-, aspartic-, threonine- and metalloendopeptidases. Serine peptidases have a serine residue involved in the active center, the aspartic have two aspartic acids in the catalytic center, cysteine-type peptidases have a cysteine residue, threonine-type peptidases have a threonine residue, and metallo-peptidases use a metal ion in the catalytic mechanism. Generally, proteases can be divided into classes based on their catalytic activity such that classes of proteases can include serine, cysteine, aspartic, threonine, or metallo-proteases. The catalytic activity of the proteases is required to cleave a target substrate. Hence, modification of a protease to alter the catalytic activity of a protease can affect (i.e. modify specificity/selectivity) the ability of a protease to cleave a particular substrate.

Each protease has a series of amino acids that lines the active site pocket and makes direct contact with the substrate. Crystallographic structures of peptidases show that the active site is commonly located in a groove on the surface of the molecule between adjacent structural domains, and the substrate specificity is dictated by the properties of binding sites arranged along the groove on one or both sides of the catalytic site that is responsible for hydrolysis of the scissile bond. Accordingly, the specificity of a peptidase is described by the ability of each subsite to accommodate a sidechain of a single amino acid residue. The sites are numbered from the catalytic site, S1, S2 . . . Sn towards the N-terminus of the substrate, and S1', S2' . . . Sn' towards the C-terminus. The residues they accommodate are numbered P1, P2 . . . Pn, and P1', P2' . . . Pn', respectively. The cleavage of a target protein is catalyzed between P1 and P1' where the amino acid residues from the N to C terminus of the polypeptide substrate are labeled (Pi, . . . , P3, P2, P1, P1', P2', P3', . . . , Pj) and their corresponding binding recognition pockets on the protease are labeled (Si, . . . , S3, S2, S1, S1', S2', S3', . . . , Sj) (Schecter and Berger (1967) *Biochem Biophys Res Commun* 27:157-162). Thus, P2 interacts with S2, P1 with S1, P1' with S1', etc. Consequently, the substrate specificity of a protease comes from the S1-S4 positions in the active site, where the protease is in contact with the P1-P4-residues of the peptide substrate sequences. In some cases, there is little (if any) interactions between the S1-S4 pockets of the active site, such that each pocket appears to recognize and bind the corresponding residue on the peptide substrate sequence independent of the other pockets. Thus, the specificity determinants can be changed in one pocket without affecting the specificity of the other pocket. Based upon numerous structures and modeling of family members, surface residues that contribute to extended substrate specificity and other secondary interactions with a substrate have been defined for many proteases including proteases of the serine, cysteine, aspartic, metallo-, and threonine families (see e.g. Wang et al., (2001) Biochemistry 40(34): 10038-46; Hopfner et al., (1999) Structure Fold Des. 7(8):989-96; Friedrich et al. (2002) J Biol. Chem. 277 (3):2160-8; Waugh et al., (2000) Nat Struct Biol. 7(9):762-5; Cameron et al., (1993) *J Biol. Chem.* 268:11711; Cameron et al., (1994) *J Biol. Chem.* 269: 11170).

i. Serine Proteases

Serine proteases (SPs), which include secreted enzymes and enzymes sequestered in cytoplasmic storage organelles, have a variety of physiological roles, including in blood coagulation, wound healing, digestion, immune responses and tumor invasion and metastasis. For example, chymotrypsin, trypsin, and elastase function in the digestive tract; Factor 10, Factor 11, Thrombin, and Plasmin are involved in clotting and wound healing; and C1r, C1s, and the C3 convertases play a role in complement activation.

A class of cell surface proteins designated type II transmembrane serine proteases are proteases which are membrane-anchored proteins with extracellular domains. As cell surface proteins, they play a role in intracellular signal transduction and in mediating cell surface proteolytic events. Other serine proteases are membrane bound and function in a similar manner. Others are secreted. Many serine proteases exert their activity upon binding to cell surface receptors, and, hence act at cell surfaces. Cell surface proteolysis is a mechanism for the generation of biologically active proteins that mediate a variety of cellular functions.

Serine proteases, including secreted and transmembrane serine proteases, are involved in processes that include neoplastic development and progression. While the precise role of these proteases has not been fully elaborated, serine proteases and inhibitors thereof are involved in the control of many intra- and extracellular physiological processes, including degradative actions in cancer cell invasion and metastatic spread, and neovascularization of tumors that are involved in tumor progression. Proteases are involved in the degradation and remodeling of extracellular matrix (ECM) and contribute to tissue remodeling, and are necessary for cancer invasion and metastasis. The activity and/or expression of some proteases have been shown to correlate with tumor progression and development.

Over 20 families (denoted S1-S27) of serine protease have been identified, these being grouped into 6 clans (SA, SB, SC, SE, SF and SG) on the basis of structural similarity and other functional evidence (Rawlings N D et al. (1994) *Meth. Enzymol.* 244: 19-61). There are similarities in the reaction mechanisms of several serine peptidases. Chymotrypsin, subtilisin and carboxypeptidase C clans have a catalytic triad of serine, aspartate and histidine in common: serine acts as a nucleophile, aspartate as an electrophile, and histidine as a base. The geometric orientations of the catalytic residues are similar between families, despite different protein folds. The linear arrangements of the catalytic residues commonly reflect clan relationships. For example the catalytic triad in the chymotrypsin clan (SA) is ordered HDS, but is ordered DHS in the subtilisin clan (SB) and SDH in the carboxypeptidase clan (SC).

Examples of serine proteases of the chymotrypsin superfamily include tissue-type plasminogen activator (tPA), trypsin, trypsin-like protease, chymotrypsin, plasmin, elastase, urokinase (or urinary-type plasminogen activator, u-PA), acrosin, activated protein C, C1 esterase, cathepsin G, chymase, and proteases of the blood coagulation cascade including kallikrein, thrombin, and Factors VIIa, IXa, Xa, XIa, and XIIa (Barret, A. J., In: *Proteinase Inhibitors*, Ed. Barrett, A. J., Et al., Elsevier, Amsterdam, Pages 3-22 (1986); Strassburger, W. et al., (1983) *FEBS Lett.*, 157:219-223; Dayhoff, M. O., Atlas of Protein Sequence and Structure, Vol 5, National Biomedical Research Foundation, Silver Spring, Md. (1972); and Rosenberg, R. D. et al. (1986) *Hosp. Prac.*, 21: 131-137).

The activity of proteases in the serine protease family is dependent on a set of amino acid residues that form their active site. One of the residues is always a serine; hence their designation as serine proteases. For example, chymotrypsin, trypsin, and elastase share a similar structure and their active serine residue is at the same position (Ser-195) in all three. Despite their similarities, they have different substrate specificities; they cleave different peptide bonds during protein digestion. For example, chymotrypsin prefers an aromatic side chain on the residue whose carbonyl carbon is part of the peptide bond to be cleaved. Trypsin prefers a positively charged Lys or Arg residue at this position. Serine proteases differ markedly in their substrate recognition properties: some are highly specific (i.e. the proteases involved in blood coagulation and the immune complement system); some are only partially specific (i.e. the mammalian digestive proteases trypsin and chymotrypsin); and others, like subtilisin, a bacterial protease, are completely non-specific. Despite these differences in specificity, the catalytic mechanism of serine proteases is well conserved.

The mechanism of cleavage of a target protein by a serine protease is based on nucleophilic attack of the targeted peptidic bond by a serine. Cysteine, threonine or water molecules associated with aspartate or metals also can play this role. In many cases the nucleophilic property of the group is improved by the presence of a histidine, held in a "proton acceptor state" by an aspartate. Aligned side chains of serine, histidine and aspartate build the catalytic triad common to most serine proteases. For example, the active site residues of chymotrypsin, and serine proteases that are members of the same family as chymotrypsin, such as for example MTSP-1, are Asp102, His57, and Ser195.

The catalytic domains of all serine proteases of the chymotrypsin superfamily have both sequence homology and structural homology. The sequence homology includes the conservation of: 1) the characteristic active site residues (e.g., Ser195, His57, and Asp102 in the case of trypsin); 2) the oxyanion hole (e.g., Gly193, Asp194 in the case of trypsin); and 3) the cysteine residues that form disulfide bridges in the structure (Hartley, B. S., (1974) *Symp. Soc. Gen. Microbiol.*, 24: 152-182). The structural homology includes 1) a common fold characterized by two Greek key structures (Richardson, J. (1981) Adv. Prot. Chem., 34:167-339); 2) a common disposition of catalytic residues; and 3) detailed preservation of the structure within the core of the molecule (Stroud, R. M. (1974) Sci. Am., 231: 24-88).

Throughout the chymotrypsin family of serine proteases, the backbone interaction between the substrate and enzyme is completely conserved, but the side chain interactions vary considerably. The identity of the amino acids that contain the S1-S4 pockets of the active site determines the substrate specificity of that particular pocket. Grafting the amino acids of one serine protease to another of the same fold modifies the specificity of one to the other. Typically, the amino acids of the protease that contain the S1-S4 pockets are those that have side chains within 4 to 5 angstroms of the substrate. The interactions these amino acids have with the protease substrate are generally called "first shell" interactions because they directly contact the substrate. There, however, can be "second shell" and "third shell" interactions that ultimately position the first shell amino acids. First shell and second shell substrate binding effects are determined primarily by loops between beta-barrel domains. Because these loops are not core elements of the protein, the integrity of the fold is maintained while loop variants with novel substrate specificities can be selected during the course of evolution to fulfill necessary metabolic or regulatory niches at the molecular level. Typically for serine proteases, the following amino acids in the primary sequence are determinants of specificity: 195, 102, 57 (the catalytic triad); 189, 190, 191, 192, and 226 (S1); 57, the loop between 58 and 64, and 99 (S2); 192, 217, 218 (S3); the loop between Cys168 and Cys180, 215, and 97 to 100 (S4); and 41 and 151 (S2'), based on chymotrypsin numbering, where an amino acid in an S1 position affects P1 specificity, an amino acid in an S2 position affects P2 specificity, an amino acid in the S3 position affects P3 specificity, and an amino acid in the S4 position affects P4 specificity. Position 189 in a serine protease is a residue buried at the bottom of the pocket that determines the S1 specificity. Structural determinants for various serine proteases are listed in Table 8 with numbering based on the numbering of mature chymotrypsin, with protease domains for each of the designated proteases aligned with that of the protease domain of chymotrypsin. The number underneath the Cys168-Cys182 and 60's loop column headings indicate the number of amino acids in the loop between the two amino acids and in the loop. The yes/no designation under the Cys191-Cys220 column headings indicates whether the disulfide bridge is present in the protease. These regions are variable within the family of chymotrypsin-like serine proteases and represent structural determinants in themselves. Modification of a protease to alter any one or more of the amino acids in the S1-S4 pocket affect the specificity or selectivity of a protease for a target substrate.

TABLE 8

The structural determinants for various serine proteases
Residues that Determine Specificity

| | S4 | | | | | S3 | | S2 | | | S1 | | | |
|---|---|---|---|---|---|---|---|---|---|---|---|---|---|---|
| | | | | | Cys168 | | | | 60's | | | | | Cys191 |
| | 171 | 174 | 180 | 215 | Cys182 | 192 | 218 | 99 | 57 | loop | 189 | 190 | 226 | Cys220 |
| Granzyme B | Leu | Tyr | Glu | Tyr | 14 | Arg | Asn | Ile | His | 6 | Gly | Ser | Arg | No |
| Granzyme A | Asn | Val | Met | Phe | 17 | Asn | Leu | Arg | His | 7 | Asp | Ser | Gly | Yes |
| Granzyme M | Arg | Ser | Met | Phe | 15 | Lys | Arg | Leu | His | 8 | Ala | Pro | Pro | Yes |
| Cathepsin G | Phe | Ser | Gln | Tyr | 13 | Lys | Ser | Ile | His | 6 | Ala | Ala | Glu | No |
| MT-SP1 | Leu | Gln | Met | Trp | 13 | Gln | Asp | Phe | His | 16 | Asp | Ser | Gly | Yes |

TABLE 8-continued

The structural determinants for various serine proteases
Residues that Determine Specificity

| | S4 | | | | | S3 | | S2 | | S1 | | | |
|---|---|---|---|---|---|---|---|---|---|---|---|---|---|
| | | | | | Cys168 | | | | 60's | | | | Cys191 |
| | 171 | 174 | 180 | 215 | Cys182 | 192 | 218 | 99 | 57 | loop | 189 | 190 | 226 | Cys220 |
| Neutrophil elastase | — | — | — | Tyr | 5 | Phe | Gly | Leu | His | 10 | Gly | Val | Asp | Yes |
| Chymase | Phe | Arg | Gln | Tyr | 12 | Lys | Ser | Phe | His | 6 | Ser | Ala | Ala | No |
| Alpha-tryptase | Tyr | Ile | Met | Trp | 22 | Lys | Glu | Ile | His | 9 | Asp | Ser | Gly | Yes |
| Beta-tryptase(I) | Tyr | Ile | Met | Trp | 22 | Gln | Glu | Val | His | 9 | Asp | Ser | Gly | Yes |
| Beta-tryptase (II) | Tyr | Ile | Met | Trp | 22 | Lys | Glu | Thr | His | 9 | Asp | Ser | Gly | Yes |
| Chymo-trypsin | Trp | Arg | Met | Trp | 13 | Met | Ser | Val | His | 7 | Ser | Ser | Gly | Yes |
| Easter | Tyr | Ser | Gln | Phe | 16 | Arg | Thr | Gln | His | 14 | Asp | Ser | Gly | Yes |
| Collagenase | Tyr | Ile | — | Phe | 12 | Asn | Ala | Ile | His | 8 | Gly | Thr | Asp | Yes |
| Factor Xa | Ser | Phe | Met | Trp | 13 | Gln | Glu | Tyr | His | 8 | Asp | Ala | Gly | Yes |
| Protein C | Met | asn | Met | Trp | 13 | Glu | Glu | Thr | His | 8 | Asp | Ala | Gly | Yes |
| Plasma kallikrein | Tyr | Gln | Met | Tyr | 13 | Arg | Pro | Phe | His | 11 | Asp | Ala | Ala | Yes |
| Plasmin | Glu | Arg | Glu | Trp | 15 | Gln | Leu | Thr | His | 11 | Asp | Ser | Gly | Yes |
| Trypsin | Tyr | Lys | Met | Trp | 13 | Gln | Tyr | Leu | His | 6 | Asp | Ser | Gly | Yes |
| Thrombin | Thr | Ile | Met | Trp | 13 | Glu | Glu | Leu | His | 16 | Asp | Ala | Gly | Yes |
| tPA | Leu | Thr | Met | Trp | 15 | Gln | Leu | Tyr | His | 11 | Asp | Ala | Gly | Yes |
| uPA | His | Ser | Met | Trp | 15 | Gln | Arg | His | His | 11 | Asp | Ser | Gly | yes |

(a) Urokinase-Type Plasminogen Activator (u-PA)

Urokinase-type plasminogen activator (u-PA, also called urinary plasminogen activator) is an exemplary protease used as a candidate for selection in the methods herein. u-PA is set forth in SEQ ID NO: 190 and encodes a precursor amino acid sequence set forth in SEQ ID NO:191. u-PA is found in urine, blood, seminal fluids, and in many cancer tissues. It is involved in a variety of biological process, which are linked to its conversion of plasminogen to plasmin, which itself is a serine protease. Plasmin has roles in a variety of normal and pathological processes including, for example, cell migration and tissue destruction through its cleavage of a variety of molecules including fibrin, fibronectin, proteoglycans, and laminin. u-PA is involved in tissue remodeling during wound healing, inflammatory cell migration, neovascularization and tumor cell invasion. u-PA also cleaves and activates other substrates, including, but not limited to, hepatocyte growth factor/scatter factor (HGF/SF), the latent form of membrane type 1 matrix metalloprotease (MT-SP1), and others.

The mature form of u-PA is a 411 residue protein (corresponding to amino acid residues 21 to 431 in the sequence of amino acids set forth in SEQ ID NO: 191, which is the precursor form containing a 20 amino acid signal peptide). u-PA contains three domains: the serine protease domain, the kringle domain and the growth factor domain. In the mature form of human u-PA, amino acids 1-158 represent the N-terminal A chain including a growth factor domain (amino acids 1-49), a kringle domain (amino acids 50-131), and an inter-domain linker region (amino acids 132-158). Amino acids 159-411 represent the C-terminal serine protease domain or B chain. u-PA is synthesized and secreted as a single-chain zymogen molecule, which is converted into an active two-chain u-PA by a variety of proteases including, for example, plasmin, kallikrein, cathepsin B, and nerve growth factor-gamma. Cleavage into the two chain form occurs between residues 158 and 159 in a mature u-PA sequence (corresponding to amino acid residues 178 and 179 in SEQ ID NO:191). The two resulting chains are kept together by a disulfide bond, thereby forming the two-chain form of u-PA.

u-PA is regulated by the binding to a high affinity cell surface receptor, uPAR. Binding of u-PA to uPAR increases the rate of plasminogen activation and enhances extracellular matrix degradation and cell invasion. The binary complex formed between uPAR and u-PA interact with membrane-associated plasminogen to form higher order activation complexes that reduce the Km (i.e. kinetic rate constant of the approximate affinity for a substrate) for plasminogen activation (Bass et al. (2002) *Biochem. Soc. Trans.*, 30: 189-194). In addition, binding of u-PA to uPAR protects the protease from inhibition by the cognate inhibitor, i.e. PAI-1. This is because single chain u-PA normally present in plasma is not susceptible to inhibition by PAI-1, and any active u-PA in the plasma will be inhibited by PAI-1. Active u-PA that is receptor bound is fully available for inhibition by PAI-1, however, PAI-1 is unable to access the bound active molecule (Bass et al. (2002) *Biochem. Soc. Trans.*, 30: 189-194). As a result, u-PA primarily functions on the cell surface and its functions are correlated with the activation of plasmin-dependent pericellular proteolysis.

The extended substrate specificity of u-PA and t-PA (discussed below) are similar, owing to the fact that both are responsible for cleaving plasminogen into active plasmin. Both u-PA and t-PA have high specificity for cleavage after P1 Arg, and they similarly show a preference for small amino acids at the P2 position. Both of the P3 and P4 positions are specificity determinants for substrates of u-PA and tPA, with a particularly prominent role of the P3 position (Ke et al. (1997) *J. Biol. Chem.*, 272: 16603-16609). The preference for amino acids at the P3 position are distinct, and is the main determinant for altered substrate discrimination between the two proteases. t-PA has a preference for aromatic amino acids (Phe and Tyr) at the P3 position, while u-PA has a preference for small polar amino acids (Thr and Ser) (see e.g., Ke et al. (1997) *J. Biol. Chem.*, 272: 16603-16609; Harris et al. (2000) *PNAS*, 97: 7754-7759).

(b) Tissue Plasminogen Activator (t-PA)

A candidate protease for selection against a protease trap in the methods herein also includes the exemplary serine protease tissue plasminogen activator (tPA), and variants thereof. t-PA is a serine protease that converts plasminogen to plasmin, which is involved in fibrinolysis or the formation of blood clots. Recombinant t-PA is used as a therapeutic in diseases characterized by blood clots, such as for example, stroke. Alternative splicing of the t-PA gene produces three transcripts. The predominant transcript is set forth in SEQ ID NO:192 and encodes a precursor protein set forth in SEQ ID NO:193 containing a 20-23 amino acid signal sequence and a 12-15 amino acid pro-sequence. The other transcripts are set forth in SEQ ID NO: 194 and 196, encoding precursor proteins having a sequence of amino acids set forth in SEQ ID NOS: 195 and 197, respectively. The mature sequence of tPA, lacking the signal sequence and propeptide sequence is 527 amino acids.

t-PA is secreted by the endothelium of blood vessels and circulates in the blood as a single-chain form. Unlike many other serine proteases, the single-chain or "proenzyme" form of t-PA has high catalytic efficiency. The activity of t-PA is increased in the presence of fibrin. In the absence of fibrin, single-chain t-PA is about 8% as active as compared to two-chain t-PA, however in the presence of fibrin the single- and two-chain forms of t-PA display similar activity. (Strandberg et al. (1995) *J. Biol. Chem.*, 270: 23444-23449). Thus, activation of single-chain t-PA can be accomplished either by activation cleavage (i.e. zymogen cleavage), resulting in a two-chain form, or by binding to the co-factor fibrin. Activation cleavage occurs following cleavage by plasmin, tissue kallikrein, and activated Factor X at amino acid positions $Arg^{275}$-$Ile^{276}$ (corresponding to $Arg^{310}$-$Ile^{311}$ in the sequence of amino acids set forth in SEQ ID NO:193) resulting in the generation of the active two-chain form of t-PA. The two-chain polypeptide contains an A and a B chain that are connected by an interchain disulfide bond.

The mature t-PA contains 16 disulfide bridges and is organized into five distinct domains (Gething et al. (1988), *The EMBO J.*, 7: 2731-2740). Residues 4-50 of the mature protein form a finger domain, residues 51-87 form an EGF-like domain, residues 88-175 and 176-263 form two kringle domains that contain three intradomain disulfide bonds each, and residues 277-527 of the mature molecule (corresponding to amino acid residues 311-562 of the precursor sequence set forth in SEQ ID NO: 193) make up the serine protease domain.

In contrast to u-PA, which acts as a cellular receptor-bound activator, t-PA functions as a fibrin-dependent circulatory activation enzyme. Likewise, both single- and two-chain forms of t-PA are susceptible to inhibition by their cognate inhibitors, for example, PAI-1, although two-chain t-PA is inhibited by PAI-1 approximately 1.4 times more rapidly than single-chain t-PA (Tachias et al. (1997) *J. Biol. Chem.*, 272: 14580-5). t-PA can become protected from inhibition by binding to its cellular binding site Annexin-II on endothelial cells. Thus, although both t-PA and u-PA both cleave and activate plasminogen, the action of t-PA in the blood supports t-PA as the primary fibrinolytic activator of plasminogen, while u-PA is the primary cellular activator of plasminogen.

(c) MT-SP1

Membrane-type serine protease MT-SP1 (also called matriptase, TADG-15, suppressor of tumorigenicity 14, ST14) is an exemplary protease for selection in the methods provided herein to select for variants with an altered substrate specificity against a desired or predetermined substrate cleavage sequence. The sequence of MT-SP1 is set forth in SEQ ID NO:252 and encodes an 855 amino acid polypeptide having a sequence of amino acids set forth in SEQ ID NO:253. It is a multidomain proteinase with a C-terminal serine proteinase domain (Friedrich et al. (2002) *J Biol Chem* 277(3):2160). A 683 amino acid variant of the protease has been isolated, but this protein appears to be a truncated form or an ectodomain form.

MT-SP1 is highly expressed or active in prostate, breast, and colorectal cancers and it can play a role in the metastasis of breast and prostate cancer. MT-SP 1 also is expressed in a variety of epithelial tissues with high levels of activity and/or expression in the human gastrointestinal tract and the prostate. Other species of MT-SP SP1 are known. For example, a mouse homolog of MT-SP1 has been identified and is called epithin.

MT-SP 1 contains a transmembrane domain, two CUB domains, four LDLR repeats, and a serine protease domain (or peptidase S1 domain; also called the B-chain) between amino acids 615-854 (or 615-855 depending on variations in the literature) in the sequence set forth in SEQ ID NO:253. The amino acid sequence of the protease domain is set forth in SEQ ID NO:505 and encoded by a sequence of nucleic acids set forth in SEQ ID NO:504. MT-SP1 is synthesized as a zymogen, and activated to double chain form by cleavage. In addition, the single chain proteolytic domain alone is catalytically active and functional.

An MT-S P1 variant, termed CB469, having a mutation of C122S corresponding to the wild-type sequence of MT-SP1 set forth in either SEQ ID NO: 253 or 505, based on chymotrypisn numbering, exhibits improved display on phagemid vectors. Such a variant MT-SP 1 is set forth in SEQ ID NO:515 (full length MT-SP1) or SEQ ID NO:507 (protease domain) and can be used in the methods described herein below.

MT-SP1 belongs to the peptidase S1 family of serine proteases (also referred to as the chymotrypsin family), which also includes chymotrypsin and trypsin. Generally, chymotrypsin family members share sequence and structural homology with chymotrypsin. MT-SP1 is numbered herein according to the numbering of mature chymotrypsin, with its protease domain aligned with that of the protease domain of chymotrypsin and its residues numbered accordingly. Based on chymotrypsin numbering, active site residues are Asp102, His57, and Ser195 (corresponding to Asp711, His656, and Ser805 in SEQ ID NO:253). The linear amino acid sequence can be aligned with that of chymotrypsin and numbered according to the β sheets of chymotrypsin. Insertions and deletions occur in the loops between the beta sheets, but throughout the structural family, the core sheets are conserved. The serine protease interacts with a substrate in a conserved beta sheet manner. Up to 6 conserved hydrogen bonds can occur between the substrate and enzyme. All serine proteases of the chymotrypsin family have a conserved region at their N-terminus of the protease domain that is necessary for catalytic activity (i.e. IIGG (SEQ ID NO: 641), VVGG (SEQ ID NO: 642), or IVGG (SEQ ID NO: 643), where the first amino acid in this quartet is numbered according to the chymotrypsin numbering and given the designation Ile16. This numbering does not reflect the length of the precursor sequence).

The substrate specificity of MT-SP 1 in the protease domain has been mapped using a positional scanning synthetic combinatorial library and substrate phage display (Takeuchi et al. (2000) *J Biol Chem* 275: 26333). Cleavage residues in substrates recognized by MT-SP1 contain Arg/Lys at P4 and basic residues or Gln at P3, small residues at P2, Arg or Lys at P1, and Ala at P1'. Effective substrates contain Lys-Arg-Ser-Arg (SEQ ID NO: 644) in the P4 to P1 sites, respectively. Generally, the substrate specificity for MT-SP1 reveals a trend whereby if P3 is basic, then P4 tends to be non-basic; and if P4 is basic, then P3 tends to be non-basic. Known substrates for MT-SP1, including, for example, proteinase-activated receptor-2 (PAR-2), single-chain uPA (sc-uPA), the proform of MT-SP1, and hepatocyte growth factor (HGF), conform to the cleavage sequence for MT-SP1 specific substrates.

MT-SP1 can cleave selected synthetic substrates as efficiently as trypsin, but exhibit a more restricted specificity for substrates than trypsin. The catalytic domain of MT-SP1 has the overall structural fold of a (chymo)trypsin-like serine protease, but displays unique properties such as a hydrophobic/acidic S2/S4 sub-sites and an exposed 60 loop. Similarly, MT-SP1 does not indiscriminately cleave peptide substrates at accessible Lys or Arg residues, but requires recognition of additional residues surrounding the scissile peptide bond. This requirement for an extended primary sequence highlights the specificity of MT-SP1 for its substrates. For example, although MT-SP1 cleaves proteinase activated receptor-2 (PAR-2) (displaying a P4 to P1 target sequence of Ser-Lys-Gly-Arg; SEQ ID NO: 645), the enzyme does not activate proteins closely related to this substrate such as PAR-1, PAR-3, and PAR-4 that do not display target sequences matching the extended MT-SP1 specificity near the scissile bond (see Friedrich et al. (2002) *J Biol Chem* 277: 2160).

The protease domain of MT-SP 1 is composed of a pro-region and a catalytic domain. The catalytically active portion of the polypeptide begins after the autoactivation site at amino acid residue 611 of the mature protein (see, e.g., SEQ ID NO: 253 at RQAR followed by the residues VVGG). The S1 pocket of MT-SP1 and trypsin are similar with good complementarity for Lys as well as Arg P1 residues, thereby accounting for some similarities in substrate cleavage with trypsin. The accommodation of the PI-Lys residues is mediated by Ser$^{190}$ whose side chain provides an additional hydrogen bond acceptor to stabilize the buried α-ammonium group (see Friedrich et al. (2002) *J Biol Chem* 277: 2160). The S2 pocket is shaped to accommodate small to medium-sized hydrophobic side chains of P2 amino acids and generally accepts a broad range of amino acids at the P2 position. Upon substrate binding, the S2 sub-site is not rigid as evidenced by the rotation of the Phe$^{99}$ benzyl group. The substrate amino acids at positions P3 (for either Gln or basic residues) and P4 (for Arg or Lys residues) appears to be mediated by electrostatic interactions in the S3 and S4 pockets with the acidic side chains of Asp-217 and/or Asp-96 which could favorably pre-orient specific basic peptide substrates as they approach the enzyme active site cleft. The side chain of a P3 residue also is able to hydrogen bond the carboxamide group of Gln$^{192}$ or alternatively, the P3 side chain can extend into the S4 sub-site to form a hydrogen bond with Phe$^{97}$ thereby weakening the inter-main chain hydrogen bonds with Gly$^{216}$. In either conformation, a basic P3 side chain is able to interact favorably with the negative potential of the MT-SP 1 S4 pocket. The mutual charge compensation and exclusion from the same S4 site explains the low probability of the simultaneous occurrence of Arg/Lys residues at P3 and P4 in good MT-SP 1 substrates. Generally, the amino acid positions of MT-SP 1 (based on chymotrypsin numbering) that contribute to extended specificity for substrate binding include: 146 and 151 (S1'); 189, 190, 191, 192, 216, 226(S1); 57, 58, 59, 60, 61, 62, 63, 64, 99 (S2); 192, 217, 218, 146 (S3); 96, 97, 98, 99, 100, 168, 169, 170, 170A, 171, 172, 173, 174, 175, 176, 178, 179, 180, 215, 217, 224 (S4).

ii. Cysteine Proteases

Cysteine proteases have a catalytic mechanism that involves a cysteine sulfhydryl group. Deprotonation of the cysteine sulfhydryl by an adjacent histidine residue is followed by nucleophilic attack of the cysteine on the peptide carbonyl carbon. A thioester linking the new carboxy-terminus to the cysteine thiol is an intermediate of the reaction (comparable to the acyl-enzyme intermediate of a serine protease). Cysteine proteases include papain, cathepsin, caspases, and calpains.

Papain-like cysteine proteases are a family of thiol dependent endo-peptidases related by structural similarity to papain. They form a two-domain protein with the domains labeled R and L (for right and left) and loops from both domains form a substrate recognition cleft. They have a catalytic triad made up of the amino acids Cys25, His159, and Asn175. Unlike serine proteases which recognize and proteolyze a target peptide based on a beta-sheet conformation of the substrate, this family of proteases does not have well-defined pockets for substrate recognition. The main substrate recognition occurs at the P2 amino acid (compared to the P1 residue in serine proteases).

The substrate specificity of a number of cysteine proteases (human cathepsin L, V, K, S, F, B, papain, and cruzain) has been determined using a complete diverse positional scanning synthetic combinatorial library (PS-SCL). The complete library contains P1, P2, P3, and P4 tetrapeptide substrates in which one position is held fixed while the other three positions are randomized with equal molar mixtures of the 20 possible amino acids, giving a total diversity of ~160,000 tetrapeptide sequences.

Overall, P1 specificity is almost identical between the cathepsins, with Arg and Lys being strongly favored while small aliphatic amino acids are tolerated. Much of the selectivity is found in the P2 position, where the human cathepsins are strictly selective for hydrophobic amino acids. Interestingly, P2 specificity for hydrophobic residues is divided between aromatic amino acids such as Phe, Tyr, and Trp (cathepsin L, V), and bulky aliphatic amino acids such as Val or Leu (cathepsin K, S, F). Compared to the P2 position, selectivity at the P3 position is significantly less stringent. Several of the proteases, however, have a distinct preference for proline (cathepsin V, S, and papain), leucine (cathepsin B), or arginine (cathepsin S, cruzain). The proteases show broad specificity at the P4 position, as no one amino acid is selected over others.

The S2 pocket is the most selective and best characterized of the protease substrate recognition sites. It is defined by the amino acids at the following spatial positions (papain numbering): 66, 67, 68, 133, 157, 160, and 205. Position 205 plays a role similar to position 189 in the serine proteases—a residue buried at the bottom of the pocket that determines the specificity. The other specificity determinants include the following amino acids (numbering according to papain): 61 and 66 (S3); 19, 20, and 158 (S1). The structural determinant for various cysteine proteases are listed in Table 9. Typically, modification of a cysteine protease, such as for example a papain protease, to alter any one or more of the amino acids in the extended specificity binding pocket or other secondary sites of interaction affect the specificity or selectivity of a protease for a target substrate including a complement protein target substrate.

TABLE 9

The structural determinants for various cysteine proteases
Residues that Determine Specificity

| | Active Site Residues | | | S3 | | S2 | | | | | S1 | | |
|---|---|---|---|---|---|---|---|---|---|---|---|---|---|
| | 25 | 159 | 175 | 61 | 66 | 66 | 133 | 157 | 160 | 205 | 19 | 20 | 158 |
| Cathepsin L | Cys | His | Asn | Glu | Gly | Gly | Ala | Met | Gly | Ala | Gln | Gly | Asp |
| Cathepsin V | Cys | His | Asn | Gln | Gly | Gly | Ala | Leu | Gly | Ala | Gln | Lys | Asp |
| Cathepsin K | Cys | His | Asn | Asp | Gly | Gly | Ala | Leu | Ala | Leu | Gln | Gly | Asn |
| Cathepsin S | Cys | His | Asn | Lys | Gly | Gly | Gly | Val | Gly | Phe | Gln | Gly | Asn |
| Cathepsin F | Cys | His | Asn | Lys | Gly | Gly | Ala | Ile | Ala | Met | Gln | Gly | Asp |
| Cathepsin B | Cys | His | Asn | Asp | Gly | Gly | Ala | Gly | Ala | Glu | Gln | Gly | Gly |
| Papain | Cys | His | Asn | Tyr | Gly | Gly | Val | Val | Ala | Ser | Gln | Gly | Asp |
| Cruzain | Cys | His | Asn | Ser | Gly | Gly | Ala | Leu | Gly | Glu | Gln | Gly | Asp |

E. Modified Proteases And Collections For Screening

Proteases or variants thereof can be used in the methods herein to identify proteases with a desired substrate specificity, most often a substrate specificity that is altered, improved, or optimized. Modified proteases to be used in the method provided herein can be generated by mutating any one or more amino acid residues of a protease using any method commonly known in the art (see also published U.S. Appln. No. 2004/0146938). Proteases for modification and the methods provided herein include, for example, full-length wild-type proteases, known variant forms of proteases, or fragments of proteases that are sufficient for catalytic activity, e.g. proteolysis of a substrate. Such modified proteases can be screened individually against a target protease trap, such as a serpin or modified serpin, or they can be screened as a collection, such as for example by using a display library, including a combinatorial library where display of the protease is by, for example, phage display, cell-surface display, bead display, ribosome display, or others. Selection of a protease that exhibits specificity and/or selectivity for a protease trap or modified form thereof, due to the formation of a stable covalent inhibitory complex, can be facilitated by any detection scheme known to one of skill in the art including, but not limited to, affinity labeling and/or purification, ELISA, chromogenic assays, fluorescence-based assays (e.g. fluorescence quenching or FRET), among others.

1. Generation of Variant Proteases

Examples of methods to mutate protease sequences include methods that result in random mutagenesis across the entire sequence or methods that result in focused mutagenesis of a select region or domain of the protease sequence. In one example, the number of mutations made to the protease is 1, 2, 3, 4, 5, 6, 7, 8, 9, 10, 11, 12, 13, 14, 15, 16, 17, 18, 19, or 20. In a preferred embodiment, the mutation(s) confer increased substrate specificity. In some examples, the activity of the protease variant is increased by at least 10-fold, 100-fold, or 1000-fold over the activity of the wild-type protease. In related aspects, the increase in activity is in substrate specificity.

a. Random Mutagenesis

Random mutagenesis methods include, for example, use of E. coli XL1red, UV irradiation, chemical modification such as by deamination, alkylation, or base analog mutagens, or PCR methods such as DNA shuffling, cassette mutagenesis, site-directed random mutagenesis, or error prone PCR (see e.g. U.S. Application No.: 2006-0115874). Such examples include, but are not limited to, chemical modification by hydroxylamine (Ruan, H., et al. (1997) Gene 188:35-39), the use of dNTP analogs (Zaccolo, M., et al. (1996) J. Mol. Biol. 255:589-603), or the use of commercially available random mutagenesis kits such as, for example, GeneMorph PCR-based random mutagenesis kits (Stratagene) or Diversify random mutagenesis kits (Clontech). The Diversify random mutagenesis kit allows the selection of a desired mutation rate for a given DNA sequence (from 2 to 8 mutations/1000 base pairs) by varying the amounts of manganese (Mn2+) and dGTP in the reaction mixture. Raising manganese levels initially increases the mutation rate, with a further mutation rate increase provided by increased concentration of dGTP. Even higher rates of mutation can be achieved by performing additional rounds of PCR.

b. Focused Mutagenesis

Focused mutation can be achieved by making one or more mutations in a pre-determined region of a gene sequence, for example, in regions of the protease domain that mediate catalytic activity. In one example, any one or more amino acids of a protease are mutated using any standard single or multiple site-directed mutagenesis kit such as for example QuikChange (Stratagene). In another example, any one or more amino acids of a protease are mutated by saturation mutagenesis (Zheng et al. (2004) Nucl. Acids. Res., 32:115), such as for example, mutagenesis of active site residues. In this example, residues that form the S1-S4 pocket of a protease (where the protease is in contact with the P1-P4 residues of the peptide substrate) and/or that have been shown to be important determinants of specificity are mutated to every possible amino acid, either alone or in combination. In some cases, there is little (if any) interaction between the S1-S4 pockets of the active site, such that each pocket appears to recognize and bind the corresponding residue on the peptide substrate sequence independent of the other pockets. Thus, the specificity determinants generally can be changed in one pocket without affecting the specificity of the other pockets. In one exemplary embodiment, a saturation mutagenesis technique is used in which the residue(s) lining the pocket are mutated to each of the 20 possible amino acids (see for example the Kunkle method, Current Protocols in Molecular Biology, John Wiley and Sons, Inc., Media Pa.). In such a technique, a degenerate mutagenic oligonucleotide primer can be synthesized which contains randomization of nucleotides at the desired codon(s) encoding the selected amino acid(s). Exemplary randomization schemes include NNS- or NNK-randomization, where N represents any nucleotide, S represents guanine or cytosine and K represents guanine or thymine. The degenerate mutagenic primer is annealed to the single stranded DNA template and DNA polymerase is added to synthesize the complementary strand of the template. After ligation, the double stranded DNA template is transformed into E. coli for amplification.

Amino acids that form the extended substrate binding pocket of exemplary proteases are described herein. Generally, the substrate specificity of a protease is known such as for example by molecular modeling based on three-dimensional structures of the complex of a protease and substrate (see for example, Wang et al., (2001) *Biochemistry* 40(34): 10038; Hopfner et al., *Structure Fold Des.* 1999 7(8):989; Friedrich et al., (2002) *J Biol Chem* 277(3):2160; Waugh et al., (2000) *Nat Struct Biol.* 7(9):762). For example, focused mutations of MT-SP1 can be in any one or more residues (based on chymotrypsin numbering) that contribute to substrate specificity including 195, 102, 157 (the catalytic triad); 189, 190, 191, 192, 216 and 226 (S1); 57, 58, 59, 60, 61, 62, 63, 64, 99 (S2); 146, 192, 217, 218 (S3); 96, 97, 98, 99, 1.00, 168, 169, 170, 170A, 171, 172, 173, 174, 175, 176, 178, 179, 180, 215, 217, 224 (S4). In another example, mutation of amino acid residues in a papain family protease can be in any one or more residues that affect P2 specificity (standard papain numbering) including 66-68, 133, 157, 160, and/or 215. In addition, residues that do not directly contact the protease substrate, but do affect the position and/or conformation of contact residues (such as for example those listed above) also can be mutated to alter the specificity of a protease scaffold.

In another example, focused amino acids for mutagenesis can be selected by sequence comparison of homologous proteases with similar substrate specificities. Consensus amino acid residues can be identified by alignment of the amino sequences of the homologous proteins, for example, alignment of regions of the protease that are involved in substrate binding. Typically, proteases with similar substrate specificities share consensus amino acids, for example, amino acids in the substrate binding pocket can be identical or similar between the compared proteases. Additionally, the amino acid sequences of proteases with differing substrate specificities can be compared to identify amino acids that can be involved in substrate recognition. These methods can be combined with methods, such as three-dimensional modeling, to identify target residues for mutagenesis.

In an additional example, focused mutagenesis can be restricted to amino acids that are identified as hot spots in the initial rounds of protease screening. For example, following selection of proteases from randomly mutagenized combinatorial libraries, several "hot spot" positions are typically observed and selected over and over again in the screening methods. Most often, since random mutagenesis broadly mutates a polypeptide sequence but with only a few mutations at each site, focused mutagenesis is used as a second strategy to specifically target hot spot positions for further mutagenesis. Focused mutagenesis of hot spot positions allows for a more diverse and deep mutagenesis at particular specified positions, as opposed to the more shallow mutagenesis that occurs following random mutagenesis of a polypeptide sequence. For example, saturation mutagenesis can be used to mutate "hot spots" such as by using oligos containing NNt/g or NNt/c at these positions. In one example, using the methods provided herein, the following hot spots have been identified in uPA as contributing to increased substrate specificity: 73, 80, 30, and 155, based on chymotrypsin numbering. Mutation of these positions can be achieved, such as for example, by using saturation mutagenesis of a wild-type or template protease sequence at one or more of these sites to create collections of protease mutants to be used in subsequent screenings.

2. Chimeric Forms of Variant Proteases

Variant proteases provided herein can include chimeric or fusion proteins. In one example, a protease fusion protein comprises at least one catalytically-active portion of a protease protein. In another example, a protease fusion protein comprises at least two or more catalytically-active portions of a protease. Within the fusion protein, the non-protease polypeptide can be fused to the N-terminus or C-terminus of the protease polypeptide. In one embodiment, the fusion protein can include a flexible peptide linker or spacer, that separates the protease from a non-protease polypeptide. In another embodiment, the fusion protein can include a tag or detectable polypeptide. Exemplary tags and detectable proteins are known in the art and include for example, but are not limited to, a histidine tag, a hemagglutinin tag, a myc tag or a fluorescent protein. In yet another embodiment, the fusion protein is a GST-protease fusion protein in which the protease sequences are fused to the N-terminus of the GST (glutathione S-transferase) sequences. Such fusion proteins can facilitate the purification of recombinant protease polypeptides. In another embodiment, the fusion protein is a Fc fusion in which the protease sequences are fused to the N-terminus of the Fc domain from immunoglobulin G. Such fusion proteins can have better pharmacodynamic properties in vivo. In another embodiment, the fusion protein is a protease protein containing a heterologous signal sequence at its N-terminus. In certain host cells (e.g., mammalian host cells), expression and/or secretion of protease can be increased through use of a heterologous signal sequence.

A protease chimeric or fusion protein can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). A protease-encoding nucleic acid can be cloned into such an expression vector such that the fusion moiety is linked in-frame to the protease protein.

3. Combinatorial Libraries and Other Libraries

The source of compounds for the screening assays, can be collections such as libraries, including, but not limited to, combinatorial libraries. Methods for synthesizing combinatorial libraries and characteristics of such combinatorial libraries are known in the art (See generally, *Combinatorial Libraries: Synthesis, Screening and Application Potential* (Cortese Ed.) Walter de Gruyter, Inc., 1995; Tietze and Lieb, *Curr. Opin. Chem. Biol.*, 2(3):363-71 (1998); Lam, *Anticancer Drug Des.*, 12(3):145-67 (1997); Blaney and Martin, *Curr. Opin. Chem. Biol.*, 1(1):54-9 (1997); and Schultz and Schultz, *Biotechnol. Prog.*, 12(6):729-43 (1996)).

Methods and strategies for generating diverse libraries, including protease or enzyme libraries, including positional scanning synthetic combinatorial libraries (PSSCL), have been developed using molecular biology methods and/or simultaneous chemical synthesis methodologies (see, e.g. Georgiou, et al. (1997) *Nat. Biotechnol.* 15:29-34; Kim et al. (2000) *Appl Environ Microbiol.* 66: 788 793; MacBeath, G. P.

et al. (1998) *Science* 279:1958-1961; Soumillion, P. L. et al. (1994) *Appl. Biochem. Biotechnol.* 47:175-189, Wang, C. I. et al. (1996). *Methods Enzymol.* 267:52-68, U.S. Pat. Nos. 6,867,010, 6,168,919, U.S. Patent Application No. 2006-0024289). The resulting combinatorial libraries potentially contain millions of compounds that can be screened to identify compounds that exhibit a selected activity.

In one example, the components of the collection or library of proteases can be displayed on a genetic package, including, but not limited to any replicable vector, such as a phage, virus, or bacterium, that can display a polypeptide moiety. The plurality of displayed polypeptides is displayed by a genetic package in such a way as to allow the polypeptide, such as a protease or catalytically active portion thereof, to bind and/or interact with a target polypeptide. Exemplary genetic packages include, but are not limited to, bacteriophages (see, e.g., Clackson et 25 al. (1991) Making Antibody Fragments Using Phage Display Libraries, *Nature,* 352:624-628; Glaser et al. (1992) Antibody Engineering by Condon-Based Mutagenesis in a Filamentous Phage Vector System, *J. Immunol.,* 149:3903 3913; Hoogenboom et al. (1991) Multi-Subunit Proteins on the Surface of Filamentous Phage: Methodologies for Displaying Antibody (Fate) Heavy and 30 Light Chains, *Nucleic Acids Res.,* 19:4133-41370), baculoviruses (see, e.g., Boublik et al., (1995) Eukaryotic Virus Display: Engineering the Major Surface Glycoproteins of the Autographa California Nuclear Polyhedrosis Virus (ACNPV) for the Presentation of Foreign Proteins on the Virus Surface, *Bio/Technology,* 13:1079-1084), bacteria and other suitable vectors for displaying a protein, such as a phage-displayed protease. For example bacteriophages of interest include, but are not limited to, T4 phage, M13 phage and HI phage. Genetic packages are optionally amplified such as in a bacterial host. Any of these genetic packages as well as any others known to those of skill in the art, are used in the methods provided herein to display a protease or catalytically active portion thereof.

a. Phage Display Libraries

Libraries of variant proteases, or catalytically active portions thereof, for screening can be expressed on the surfaces bacteriophages, such as, but not limited to, M13, fd, fl, T7, and λ phages (see, e.g., Santini (1998) *J. Mol. Biol.* 282:125-135; Rosenberg et al. (1996) *Innovations* 6:1-6; Houshmand et al. (1999) *Anal Biochem* 268:363-370, Zanghi et al. (2005) *Nuc. Acid Res.* 33(18)e 160:1-8). The variant proteases can be fused to a bacteriophage coat protein with covalent, non-covalent, or non-peptide bonds. (See, e.g., U.S. Pat. No. 5,223,409, Crameri et al. (1993) *Gene* 137:69 and WO 01/05950). Nucleic acids encoding the variant proteases can be fused to nucleic acids encoding the coat protein to produce a protease-coat protein fusion protein, where the variant protein is expressed on the surface of the bacteriophage. For example, nucleic acid encoding the variant protease can be fused to nucleic acids encoding the C-terminal domain of filamentous phase M13 Gene III (gIIIp; SEQ ID NO:512). In some examples, a mutant protease exhibiting improved display on the phage is used as a template to generate mutant phage display libraries as described herein. For example, as described in Example 8, a mutant MT-SP1 having the mutation of serine to cysteine at position corresponding to position 122 of wild-type MT-S P1, based on chymotrypsin numbering exhibits improved phage display. Hence, such a mutant can be used as the template from which to generate diversity in the library.

Additionally, the fusion protein can include a flexible peptide linker or spacer, a tag or detectable polypeptide, a protease site, or additional amino acid modifications to improve the expression and/or utility of the fusion protein. For example, addition of a protease site can allow for efficient recovery of desired bacteriophages following a selection procedure. Exemplary tags and detectable proteins are known in the art and include for example, but not limited to, a histidine tag, a hemagglutinin tag, a myc tag or a fluorescent protein. In another example, the nucleic acid encoding the protease-coat protein fusion can be fused to a leader sequence in order to improve the expression of the polypeptide. Exemplary of leader sequences include, but are not limited to, STII or OmpA. Phage display is described, for example, in Ladner et al., U.S. Pat. No. 5,223,409; Rodi et al. (2002) *Curr. Opin. Chem. Biol.* 6:92-96; Smith (1985) *Science* 228:1315-1317; WO 92/18619; WO 91/17271; WO 92/20791; WO 92/15679; WO 93/01288; WO 92/01047; WO 92/09690; WO 90/02809; de Haard et al. (1999) *J. Biol. Chem.* 274:18218-30; Hoogenboom et al. (1998) Immunotechnology 4:1-20; Hoogenboom et al. (2000) Immunol Today 2:371-8; Fuchs et al. (1991) *Bio/Technology* 9:1370-1372; Hay et al. (1992) *Hum Antibod Hybridomas* 3:81-85; Huse et al. (1989) *Science* 246:1275-1281; Griffiths et al. (1993) *EMBO J.* 12:725-734; Hawkins et al. (1992) *J Mol Biol* 226:889-896; Clackson et al. (1991) *Nature* 352:624-628; Gram et al. (1992) *PNAS* 89:3576-3580; Garrard et al. (1991) *Bio/Technology* 9:1373-1377; Rebar et al. (1996) *Methods Enzymol.* 267:129-49; Hoogenboom et al. (1991) *Nuc Acid Res* 19:4133-4137; and Barbas et al. (1991) *PNAS* 88:7978-7982.

Nucleic acids suitable for phage display, e.g., phage vectors, are known in the art (see, e.g., Andris-Widhopf et al. (2000) *J Immunol Methods,* 28: 159-81; Armstrong et al. (1996) Academic Press, Kay et al., Ed. pp. 35-53; Corey et al. (1993) *Gene* 128(1):129-34; Cwirla et al. (1990) *Proc Natl Acad Sci USA* 87(16):6378-82; Fowlkes et al. (1992) *Biotechniques* 13(3):422-8; Hoogenboom et al. (1991) *Nuc Acid Res* 19(15):4133-7; McCafferty et al. (1990) *Nature* 348(6301): 552-4; McConnell et al. (1994) *Gene* 151(1-2):115-8; Scott and Smith (1990) *Science* 249(4967):386-90).

A library of nucleic acids encoding the protease-coat protein fusion proteins, typically protease variants generated as described above, can be incorporated into the genome of the bacteriophage, or alternatively inserted into in a phagemid vector. In a phagemid system, the nucleic acid encoding the display protein is provided on a phagemid vector, typically of length less than 6000 nucleotides. The phagemid vector includes a phage origin of replication so that the plasmid is incorporated into bacteriophage particles when bacterial cells bearing the plasmid are infected with helper phage, e.g. M13K01 or M13VCS. Phagemids, however, lack a sufficient set of phage genes in order to produce stable phage particles after infection. These phage genes can be provided by a helper phage. Typically, the helper phage provides an intact copy of the gene III coat protein and other phage genes required for phage replication and assembly. Because the helper phage has a defective origin of replication, the helper phage genome is not efficiently incorporated into phage particles relative to the plasmid that has a wild type origin. See, e.g., U.S. Pat. No. 5,821,047. The phagemid genome contains a selectable marker gene, e.g. Amp.sup.R or Kan.sup.R (for ampicillin or kanamycin resistance, respectively) for the selection of cells that are infected by a member of the library.

In another example of phage display, vectors can be used that carry nucleic acids encoding a set of phage genes sufficient to produce an infectious phage particle when expressed, a phage packaging signal, and an autonomous replication sequence. For example, the vector can be a phage genome that has been modified to include a sequence encoding the display protein. Phage display vectors can further include a site into which a foreign nucleic acid sequence can be inserted, such as a multiple cloning site containing restriction enzyme digestion sites. Foreign nucleic acid sequences, e.g., that encode display proteins in phage vectors, can be linked to a ribosomal binding site, a signal sequence (e.g., a M13 signal sequence), and a transcriptional terminator sequence.

Vectors can be constructed by standard cloning techniques to contain sequence encoding a polypeptide that includes a protease and a portion of a phage coat protein, and which is operably linked to a regulatable promoter. In some examples, a phage display vector includes two nucleic acid sequences that encode the same region of a phage coat protein. For example, the vector includes one sequence that encodes such a region in a position operably linked to the sequence encoding the display protein, and another sequence which encodes such a region in the context of the functional phage gene (e.g., a wild-type phage gene) that encodes the coat protein. Expression of both the wild-type and fusion coat proteins can aid in the production of mature phage by lowering the amount of fusion protein made per phage particle. Such methods are particularly useful in situations where the fusion protein is less tolerated by the phage.

Phage display systems typically utilize filamentous phage, such as M13, fd, and fl. In some examples using filamentous phage, the display protein is fused to a phage coat protein anchor domain. The fusion protein can be co-expressed with another polypeptide having the same anchor domain, e.g., a wild-type or endogenous copy of the coat protein. Phage coat proteins that can be used for protein display include (i) minor coat proteins of filamentous phage, such as gene III protein (gIIIp), and (ii) major coat proteins of filamentous phage such as gene VIII protein (gVIIIp). Fusions to other phage coat proteins such as gene VI protein, gene VII protein, or gene IX protein also can be used (see, e.g., WO 00/71694).

Portions (e.g., domains or fragments) of these proteins also can be used. Useful portions include domains that are stably incorporated into the phage particle, e.g., so that the fusion protein remains in the particle throughout a selection procedure. In one example, the anchor domain of gIIIp is used (see, e.g., U.S. Pat. No. 5,658,727 and Examples below). In another example, gVIIIp is used (see, e.g., U.S. Pat. No. 5,223,409), which can be a mature, full-length gVIIIp fused to the display protein. The filamentous phage display systems typically use protein fusions to attach the heterologous amino acid sequence to a phage coat protein or anchor domain. For example, the phage can include a gene that encodes a signal sequence, the heterologous amino acid sequence, and the anchor domain, e.g., a gIIIp anchor domain.

Valency of the expressed fusion protein can be controlled by choice of phage coat protein. For example, gIIIp proteins typically are incorporated into the phage coat at three to five copies per virion. Fusion of gIIIp to variant proteases thus produces a low-valency. In comparison, gVIII proteins typically are incorporated into the phage coat at 2700 copies per virion (Marvin (1998) *Curr. Opin. Struct. Biol.* 8:150-158). Due to the high-valency of gVIIIp, peptides greater than ten residues are generally not well tolerated by the phage. Phagemid systems can be used to increase the tolerance of the phage to larger peptides, by providing wild-type copies of the coat proteins to decrease the valency of the fusion protein. Additionally, mutants of gVIIIp can be used which are optimized for expression of larger peptides. In one such example, a mutant gVIIp was obtained in a mutagenesis screen for gVIIIp with improved surface display properties (Sidhu et al. (2000) *J. Mol. Biol.* 296:487-495).

Regulatable promoters also can be used to control the valency of the display protein. Regulated expression can be used to produce phage that have a low valency of the display protein. Many regulatable (e.g., inducible and/or repressible) promoter sequences are known. Such sequences include regulatable promoters whose activity can be altered or regulated by the intervention of user, e.g., by manipulation of an environmental parameter, such as, for example, temperature or by addition of stimulatory molecule or removal of a repressor molecule. For example, an exogenous chemical compound can be added to regulate transcription of some promoters. Regulatable promoters can contain binding sites for one or more transcriptional activator or repressor protein. Synthetic promoters that include transcription factor binding sites can be constructed and also can be used as regulatable promoters. Exemplary regulatable promoters include promoters responsive to an environmental parameter, e.g., thermal changes, hormones, metals, metabolites, antibiotics, or chemical agents. Regulatable promoters appropriate for use in *E. coli* include promoters which contain transcription factor binding sites from the lac, tac, trp, trc, and tet operator sequences, or operons, the alkaline phosphatase promoter (pho), an arabinose promoter such as an araBAD promoter, the rhamnose promoter, the promoters themselves, or functional fragments thereof (see, e.g., Elvin et al. (1990) *Gene* 37: 123-126; Tabor and Richardson, (1998) *Proc. Natl. Acad. Sci. U.S.* 1074-1078; Chang et al. (1986) *Gene* 44: 121-125; Lutz and Bujard, (1997) *Nucl. Acids. Res.* 25: 1203-1210; D. V Goeddel et al. (1979) *Proc. Nat. Acad. Sci. U.S.A.*, 76:106-110; J. D. Windass et al. (1982) *Nucl. Acids. Res.*, 10:6639-57; R. Crowl et al. (1985) *Gene*, 38:31-38; Brosius (1984) *Gene* 27: 161-172; Amanna and Brosius, (1985) *Gene* 40: 183-190; Guzman et al. (1992) *J. Bacteriol.*, 174: 7716-7728; Haldimann et al. (1998) *J. Bacteriol.*, 180: 1277-1286).

The lac promoter, for example, can be induced by lactose or structurally related molecules such as isopropyl-beta-D-thiogalactoside (IPTG) and is repressed by glucose. Some inducible promoters are induced by a process of derepression, e.g., inactivation of a repressor molecule.

A regulatable promoter sequence also can be indirectly regulated. Examples of promoters that can be engineered for indirect regulation include: the phage lambda $P_R$, $P_L$, phage T7, SP6, and T5 promoters. For example, the regulatory sequence is repressed or activated by a factor whose expression is regulated, e.g., by an environmental parameter. One example of such a promoter is a T7 promoter. The expression of the T7 RNA polymerase can be regulated by an environmentally-responsive promoter such as the lac promoter. For example, the cell can include a heterologous nucleic acid that includes a sequence encoding the T7 RNA polymerase and a regulatory sequence (e.g., the lac promoter) that is regulated by an environmental parameter. The activity of the T7 RNA polymerase also can be regulated by the presence of a natural inhibitor of RNA polymerase, such as T7 lysozyme.

In another configuration, the lambda $P_L$ can be engineered to be regulated by an environmental parameter. For example, the cell can include a nucleic acid sequence that encodes a temperature sensitive variant of the lambda repressor. Raising cells to the non-permissive temperature releases the $P_L$ promoter from repression.

The regulatory properties of a promoter or transcriptional regulatory sequence can be easily tested by operably linking the promoter or sequence to a sequence encoding a reporter protein (or any detectable protein). This promoter-report fusion sequence is introduced into a bacterial cell, typically in a plasmid or vector, and the abundance of the reporter protein is evaluated under a variety of environmental conditions. A useful promoter or sequence is one that is selectively activated or repressed in certain conditions.

In some embodiments, non-regulatable promoters are used. For example, a promoter can be selected that produces an appropriate amount of transcription under the relevant conditions. An example of a non-regulatable promoter is the gill promoter.

b. Cell Surface Display Libraries

Libraries of variant proteases for screening can be expressed on the surfaces of cells, for example, prokaryotic or eukaryotic cells. Exemplary cells for cell surface expression include, but are not limited to, bacteria, yeast, insect cells, avian cells, plant cells, and mammalian cells (Chen and Georgiou (2002) *Biotechnol Bioeng* 79: 496-503). In one example, the bacterial cells for expression are *Escherichia coli*.

Variant proteases can be expressed as a fusion protein with a protein that is expressed on the surface of the cell, such as a membrane protein or cell surface-associated protein. For example, a variant protease can be expressed in *E. coli* as a fusion protein with an *E. coli* outer membrane protein (e.g. OmpA), a genetically engineered hybrid molecule of the major *E. coli* lipoprotein (Lpp) and the outer membrane protein OmpA or a cell surface-associated protein (e.g. pili and flagellar subunits). Generally, when bacterial outer membrane proteins are used for display of heterologous peptides or proteins, it is achieved through genetic insertion into permissive sites of the carrier proteins. Expression of a heterologous peptide or protein is dependent on the structural properties of the inserted protein domain, since the peptide or protein is more constrained when inserted into a permissive site as compared to fusion at the N- or C-terminus of a protein. Modifications to the fusion protein can be done to improve the expression of the fusion protein, such as the insertion of flexible peptide linker or spacer sequences or modification of the bacterial protein (e.g. by mutation, insertion, or deletion, in the amino acid sequence). Enzymes, such as β-lacatamase and the Cex exoglucanase of *Cellulomonas fimi*, have been successfully expressed as Lpp-OmpA fusion proteins on the surface of *E. coli* (Francisco J. A. and Georgiou G. *Ann NY Acad Sci*. 745:372-382 (1994) and Georgiou G. et al. *Protein Eng*. 9:239-247 (1996)). Other peptides of 15-514 amino acids have been displayed in the second, third, and fourth outer loops on the surface of OmpA (Samuelson et al. *J. Biotechnol*. 96: 129-154 (2002)). Thus, outer membrane proteins can carry and display heterologous gene products on the outer surface of bacteria.

In another example, variant proteases can be fused to autotransporter domains of proteins such as the *N. gonorrhoeae* IgA1 protease, *Serratia marcescens* serine protease, the *Shigella flexneri* VirG protein, and the *E. coli* adhesin AIDA-I (Klauser et al. *EMBO J*. 1991-1999 (1990); Shikata S, et al. *J. Biochem*. 114:723-731 (1993); Suzuki T et al. *J Biol. Chem*. 270:30874-30880 (1995); and Maurer J et al. *J. Bacteriol*. 179:794-804 (1997)). Other autotransporter proteins include those present in gram-negative species (e.g. *E. coli, Salmonella* serovar *Typhimurium*, and *S. flexneri*). Enzymes, such as β-lactamase, have been successful expressed on the surface of *E. coli* using this system (Lattemann C T et al. *J Bacteriol*. 182(13): 3726-3733 (2000)).

Bacteria can be recombinantly engineered to express a fusion protein, such a membrane fusion protein. Nucleic acids encoding the variant proteases can be fused to nucleic acids encoding a cell surface protein, such as, but not limited to, a bacterial OmpA protein. The nucleic acids encoding the variant proteases can be inserted into a permissible site in the membrane protein, such as an extracellular loop of the membrane protein. Additionally, a nucleic acid encoding the fusion protein can be fused to a nucleic acid encoding a tag or detectable protein. Such tags and detectable proteins are known in the art and include for example, but are not limited to, a histidine tag, a hemagglutinin tag, a myc tag or a fluorescent protein. The nucleic acids encoding the fusion proteins can be operably linked to a promoter for expression in the bacteria. For example a nucleic acid can be inserted in a vector or plasmid, which can carry a promoter for expression of the fusion protein and optionally, additional genes for selection, such as for antibiotic resistance. The bacteria can be transformed with such plasmids, such as by electroporation or chemical transformation. Such techniques are known to one of ordinary skill in the art.

Proteins in the outer membrane or periplasmic space are usually synthesized in the cytoplasm as premature proteins, which are cleaved at a signal sequence to produce the mature protein that is exported outside the cytoplasm. Exemplary signal sequences used for secretory production of recombinant proteins for *E. coli* are known. The N-terminal amino acid sequence, without the Met extension, can be obtained after cleavage by the signal peptidase when a gene of interest is correctly fused to a signal sequence. Thus, a mature protein can be produced without changing the amino acid sequence of the protein of interest (Choi and Lee. *Appl. Microbiol. Biotechnol*. 64: 625-635 (2004)).

Other cell surface display systems are known in the art and include, but are not limited to ice nucleation protein (Inp)-based bacterial surface display system (Lebeault J M (1998) *Nat. Biotechnol*. 16: 576 80), yeast display (e.g. fusions with the yeast Aga2p cell wall protein; see U.S. Pat. No. 6,423, 538), insect cell display (e.g. baculovirus display; see Ernst et al. (1998) Nucleic Acids Research, Vol 26, Issue 7 1718-1723), mammalian cell display, and other eukaryotic display systems (see e.g. U.S. Pat. No. 5,789,208 and WO 03/029456).

c. Other Display Libraries

It also is possible to use other display formats to screen libraries of variant proteases, e.g., libraries whose variation is designed as described herein. Exemplary other display formats include nucleic acid-protein fusions, ribozyme display (see e.g. Hanes and Pluckthun (1997) *Proc. Natl. Acad. Sci. U.S.A.* 13:4937-4942), bead display (Lam, K. S. et al. *Nature* (1991) 354, 82-84; K. S. et al. (1991) *Nature,* 354, 82-84; Houghten, R. A. et al. (1991) *Nature,* 354, 84-86; Furka, A. et al. (1991) *Int. J. Peptide Protein Res*. 37, 487-493; Lam, K. S., et al. (1997) *Chem. Rev.,* 97, 411-448; U.S. Published Patent Application 2004-0235054) and protein arrays (see e.g. Cahill (2001) *J. Immunol. Meth*. 250:81-91, WO 01/40803, WO 99/51773, and US2002-0192673-A1)

In specific other cases, it can be advantageous to instead attach the proteases, variant proteases, or catalytically active portions or phage libraries or cells expressing variant proteases to a solid support. For example, in some examples, cells expressing variant proteases can be naturally adsorbed to a bead, such that a population of beads contains a single cell per bead (Freeman et al. *Biotechnol. Bioeng*. (2004) 86:196-200). Following immobilization to a glass support, microcolonies can be grown and screened with a chromogenic or fluorogenic substrate. In another example, variant proteases or phage libraries or cells expressing variant proteases can be arrayed into titer plates and immobilized.

F. Methods of Contacting, Isolating, and Identifying Selected Proteases

After a Plurality of collections or libraries displaying proteases or catalytically active portions thereof have been chosen and prepared, the libraries are used to contact a target protease trap polypeptide with the protease components. The target substrates, including, for example, a protease trap polypeptide such as a serpin mutated in its RSL loop to have a desired cleavage sequence, are contacted with the displayed protease libraries for selection of a protease with altered substrate specificity. The protease and protease trap polypeptide can be contacted in suspension, solution, or via a solid support. The components are contacted for a sufficient time, temperature, or concentration for interaction to occur and for the subsequent cleavage reaction and formation of a stable intermediate complex of the selected protease and protease trap polypeptide. The stringency by which the reaction is maintained can be modulated by changing one or more parameters from among the temperature of the reaction, concentration of the protease trap polypeptide inhibitor, concentration of a competitor (if included), concentration of the collection of proteases in the mixture, and length of time of the incubation.

The selected proteases that form covalent complexes with the protease trap polypeptide are captured and isolated. To facilitate capture, protease trap polypeptides for screening against can be provided in solution, in suspension, or attached to a solid support, as appropriate for the assay method. For example, the protease trap polypeptide can be attached to a solid support, such as for example, one or more beads or particles, microspheres, a surface of a tube or plate, a filter membrane, and other solid supports known in the art. Exemplary solid support systems include, but are not limited to, a flat surface constructed, for example, of glass, silicon, metal, nylon, cellulose, plastic or a composite, including multiwell plates or membranes; or can be in the form of a bead such as a silica gel, a controlled pore glass, a magnetic (Dynabead) or cellulose bead. Such methods can be adapted for use in suspension or in the form of a column. Target protease trap polypeptides can be attached directly or indirectly to a solid support, such as a polyacrylamide bead. Covalent or non-covalent methods can be used for attachment. Covalent methods of attachment of target compounds include chemical crosslinking methods. Reactive reagents can create covalent bonds between functional groups on the target molecule and the support. Examples of functional groups that can be chemically reacted are amino, thiol, and carboxyl groups. N-ethylmaleimide, iodoacetamide, N-hydrosuccinimide, and glutaraldehyde are examples of reagents that react with functional groups. In other examples, target substrates can be indirectly attached to a solid support by methods such as, but not limited to, immunoaffinity or ligand-receptor interactions (e.g. biotin-streptavidin or glutathione S-transferase-glutathione). For example, a protease-trap polypeptide can be coated to an ELISA plate, or other similar addressable array. In one example, the wells of the plate can be coated with an affinity capture agent, which binds to and captures the protease-trap polypeptide. Example 9 exemplifies a method whereby biotinylated anti-His antibody is coated onto a streptavidin containing plate to facilitate capture of a protease-trap polypeptide containing a His-tag.

Attachment of the protease trap polypeptide to a solid support can be performed either before, during, or subsequent to their contact with variant proteases or phage libraries or cells expressing variant proteases. For example, target substrates can be pre-absorbed to a solid support, such as a chromatography column, prior to incubation with the variant protease. In other examples, the attachment of a solid support is performed after the target substrate is bound to the variant protease.

In such an example, the solid support containing the complexed substrate-protease pair can be washed to remove any unbound protease. The complex can be recovered from the solid support by any method known to one of skill in the art, such as for example, by treatment with dilute acid, followed by neutralization (Fu et al. (1997) J. Biol. Chem. 272:25678-25684) or with triethylamine (Chiswell et al. (1992) Trends Biotechnol. 10:80-84). This step can be optimized to ensure reproducible and quantitative recovery of the display source from the solid substrate. For example, the binding of the display source to the target substrate attached to the solid support can be monitored independently using methods well known to those of skill in the art, such as by using an antibody directed against the phage, such as against M13 phage (e.g., New England Biolabs, MA) and a standard ELISA (see e.g., Ausubel et al. (1987) Current Protocols in Molecular Biology, John Wiley & Sons, New York).

Another method of capturing and isolating a substrate-protease complex is from solution. Typically, in such a method, a protease trap polypeptide or variant thereof is contacted with a collection of proteases such as, for example, in a small volume of an appropriate binding buffer (i.e. 20, 30, 40, 50, 60, 70, 80, 90, 100, 200, 300, 400, 500 or more microliters) where each protease trap polypeptide is associated with a predetermined marker, tag, or other detectable moiety for identification and isolation thereof. The detectable moiety can be any moiety that facilitates the detection and isolation of substrate-protease complex. For example, the moiety can be an epitope tag for which an antibody specific for the tag exists (i.e. myc-tag, His-tag, or others). The antibody can be bound to a solid support, such as a bead, to facilitate capture of the stable complex. Other similar strategies can be used and include, for example, labeling of the target substrate with biotin and capture using streptavidin attached to a solid support such as magnetic beads or a microtiter plate or labeling with polyhistidine (e.g., His 6-tag) and capture using a metal chelating agent such as, but not limited to, nickel sulphate ($NiSO_4$), cobalt chloride ($CoCl_2$), copper sulphate ($CuSO_4$), or zinc chloride ($ZnCl_2$). The capturing agents can be coupled to large beads, such as for example, sepharose beads, whereby isolation of the bound beads can be easily achieved by centrifugation. Alternatively, capturing agents can be coupled to smaller beads, such as for example, magnetic beads (i.e. Miltenyi Biotec), that can be easily isolated using a magnetic column. In addition, the moiety can be a fluorescent moiety. For example, in some display systems, such as for example, cell surface display systems, a fluorescent label can facilitate isolation of the selected complex by fluorescence activated cell sorting (FACS; see e.g., Levin et al. (2006) Molecular BioSystems, 2: 49-57).

In some instances, one or more distinct protease trap polypeptides are contacted with a collection of proteases, where each of the protease trap polypeptides are associated with different detection moieties so as to individually isolate one or more than one protease trap polypeptide-protease complex. The ability to include in a single reaction 1, 2, 3, 4, 5, 6, 7, 8, 9, 10, or more distinct protease trap polypeptides, each with a different desired RSL cleavage sequence, permits the detection and isolation of tens of hundreds or thousands of covalent complexes simultaneously.

The selected proteases, captured as covalent complexes with the protease trap polypeptide, can be separated from uncomplexed proteases from the collection of proteases. The selected proteasescan then be amplified to facilitate identification of the selected protease. After removal of any uncomplexed proteases to the protease trap polypeptide, the source of material to which the protease is displayed (i.e. phage, cells, beads, etc. . . . ) is amplified and expressed in an appropriate host cell. For example, where the protease is displayed on phage, generally, the protease-phage in complex with a protease trap polypeptide is incubated with a host cell to allow phage adsorption, followed by addition of a small volume of nutrient broth and agitation of the culture to facilitate phage probe DNA replication in the multiplying host. In some examples, this is done in the presence of helper phage in order to ensure that the host cells are infected by the phage. After this incubation, the media is supplemented with an antibiotic and/or an inducer. The phage protease genome also can contain a gene encoding resistance to the antibiotic to allow for selective growth of those bacterial cells that maintain the phage protease DNA. Typically, for amplification of phage as a source of phage supernatant containing selected proteases, rescue of the phage is required by the use of helper phage. In some examples, it is possible to assay for the presence of a selected protease without a rescue step. For example, following incubation of the captured complex containing the selected or identified protease with a host cell, for example, bacteria, and growth in the presence of a selective agent, the periplasm or cell culture medium can be directly sampled as a source of the selected protease, for example, to measure protease activity. Such a procedure is described in Example 17.

Additionally, the amplification of the display source, such as in a bacterial host, can be optimized in a variety of ways. For example, the amount of bacteria added to the assay material, such as in microwells, can be in vast excess of the phage source recovered from the binding step thereby ensuring quantitative transduction of the phage genome. The efficiency of transduction optionally can be measured when phage are selected. The amplification step amplifies the genome of the display source, such as phage genomes, allowing over-expression of the associated signature polypeptide and identification thereof, such as by DNA sequencing.

A panning approach can be used whereby proteases or catalytically active portions thereof that interact with a target protein, such as a protease trap polypeptide or RSL variant thereof, are quickly selected. Panning is carried out, for example, by incubating a library of phage-displayed polypeptides, such as phage-displayed proteases, with a surface-bound or soluble target protein, washing away the unbound phage, and eluting the specifically and covalently-bound phage. The eluted phage is then amplified, such as via infection of a host, and taken through additional cycles of panning and amplification to successively enrich the pool of phage for those with the highest affinities for the target polypeptide. After several rounds, individual clones are identified, such as by DNA sequencing, and their activity can be measured, such as by any method set forth in Section G below.

Once the selected protease is identified, it can be purified from the display source and tested for activity. Generally, such methods include general biochemical and recombinant DNA techniques and are routine to those of skill in the art. In one method, polyethylene glycol (PEG) precipitation can be used to remove potentially contaminating protease activity in the purified selected phage supernatants. In such an example, following phage rescue in the presence of helper phage, phage supernatant containing the selected protease can be precipitated in the presence of PEG. One of skill in the art is able to determine the percentage of PEG required for the particular precipitation application. Generally, for precipitation of protease supernatants, 20% PEG is used.

In some examples, the supernatant, either from the rescued phage supernatant, or from the bacterial cell periplasm or cell medium (without phage rescue) can be assayed for protease activity as described herein. Alternatively or additionally, the selected protease can be purified from the supernatant or other source. For example, DNA encoding the selected protease domain can be isolated from the display source to enable purification of the selected protein. For example, following infection of E. coli host cells with selected phage as set forth above, the individual clones can be picked and grown up for plasmid purification using any method known to one of skill in the art, and if necessary can be prepared in large quantities, such as for example, using the Midi Plasmid Purification Kit (Qiagen). The purified plasmid can used for DNA sequencing to identify the sequence of the variant protease, or can be used to transfect into any cell for expression, such as but not limited to, a mammalian expression system. If necessary, one or two-step PCR can be performed to amplify the selected sequence, which can be subcloned into an expression vector of choice. The PCR primers can be designed to facilitate subcloning, such as by including the addition of restriction enzyme sites. Example 4 exemplifies a two step PCR procedure to accomplish amplification and purification of the full-length u-PA gene, where the selected protease phage contained only the protease domain of the u-PA gene. Following transfection into the appropriate cells for expression such as is described in detail below, conditioned medium containing the protease polypeptide, or catalytically active portion thereof can be tested in activity assays or can be used for further purification. In addition, if necessary, the protease can be processed accordingly to yield an active protease, such as by cleavage of a single chain form, into a two chain form. Such manipulations are known to one of skill in the art. For example, single chain u-PA can be made active the cleavage of plasmin such as is described herein.

1. Iterative Screening

In the methods provided herein, iterative screening is employed to optimize the modification of the proteases. Thus, in methods of iterative screening, a protease can be evolved by performing the panning reactions a plurality of times under various parameters, such as for example, by using different protease trap polypeptides or competitors. In such methods of iterative screening, the protease collection can be kept constant in successive rounds of screening. Alternatively, a new protease collection can be generated containing only the selected proteases identified in the preceding rounds and/or by creating a new collection of mutant proteases that have been further mutated as compared to a template protease identified in the first round.

In one example, a first round screening of the protease library can identify variant proteases containing one or more mutations which alter the specificity of the protease. A second round library synthesis can then be performed in which the amino acid positions of the one or mutations are held constant, and focused or random mutagenesis is carried out on the remainder of the protein or desired region or residue. After an additional round of screening, the selected protease can be subjected to additional rounds of library synthesis and screening. For example, 2, 3, 4, 5, or more rounds of library synthesis and screening can be performed. In some examples, the specificity of the variant protease toward the altered substrate is further optimized with each round of selection.

In another method of iterative screening, a first round screening of a protease collection can be against an intermediate protease trap polypeptide to identify variant proteases containing one or more mutations which alter the specificity of the protease to the intermediate substrate. The selected protease complexes can be isolated, grown up, and amplified in the appropriate host cells and used as the protease collection in a second round of screening against a protease trap polypeptide containing the complete cleavage sequence of a target polypeptide. For example, such an approach can be used to select for proteases having substrate specificity for a VEGFR cleavage sequence where the one or more rounds of panning are against a RRARM intermediate cleavage sequence (SEQ ID NO: 379), and subsequent rounds of panning are performed against a protease trap polypeptide containing the VEGFR2 cleavage sequence RRVR (SEQ ID NO: 489).

In an additional example of iterative screening, two or more protease trap polypeptides containing different substrate recognition or cleavage sequences for two or more different polypeptides are used in the methods in alternative rounds of panning. Such a method is useful to select for proteases that are optimized to have selectivity for two different substrates. The selected variants typically have narrow specificity, but high activity towards two or more substrate recognition sequences. In such methods, a first round screening of a protease collection against a first protease trap polypeptide, that has been modified to select for a protease with a first predetermined substrate specificity, can identify variant proteases containing one or more mutations which alter the specificity of the protease. The selected proteases can be isolated, grown up, and amplified in the appropriate host cells and used as the protease collection in a second round of screening against a second protease trap polypeptide that has been modified to select for a protease with a second predetermined substrate specificity. The first and second protease trap polypeptide used in the methods can be the same or different, but each is differently modified in its reactive site to mimic a substrate recognition site (i.e. cleavage sequence) of different target substrates. In some examples, the stringency in the selection can be enhanced in the presence of competitors, such as for example, narrow or broad competitors as described herein.

2. Exemplary Selected Proteases

Provided herein are variant u-PA and MT-SP1 polypeptides identified in the methods provided herein as having an altered and/or improved substrate specificity. Such variant u-PA and MT-SP1 polypeptides were identified as having an increased specificity for a selected or desired cleavage sequence of a target protein. Exemplary of such target proteins include, but are not limited to, a cleavage sequence in a VEGFR or a complement protein, for example, complement protein C2. Any modified serpin can be used in the selection methods herein to identify variant proteases. Exemplary of such modified serpins are PAI-1 or AT3 modified in their RSL to contain cleavage sequences for a target protein, for example, a VEGFR or C2, as described herein above. The resulting selected modified proteases exhibit altered, typically improved, substrate specificity for the cleavage sequence in the target protein as compared to the template or starting protease, which does not contain the selected modifications. As described below, specificity is typically increased and is generally at least 2-fold, at least 4-fold, at least 5-fold, at least 6-fold, at least 7-fold, 8, 9, 10, 20, 30, 40, 50, 60, 70, 80, 90, 100, 200, 300, 400, 500, 600, 700, 800, 900, 1000 times or more when compared to the specificity of a wild-type or template protease for the target substrate selected against versus a non-target substrate.

a. Variant u-PA Polypeptides

For example, variant u-PA polypeptides provided herein were selected for to have an increased reactivity for a mutant serpin polypeptide modified in its RSL sequence by replacement of the native P4-P1' reactive site amino acids with those of a desired or selected target protein. In one example, variant u-PA polypeptides were identified against selection of a modified PAI-1 polypeptide. Examples of modified PAI-1 polypeptide molecules used in the u-PA selection methods provided herein include, for example, PAI-1 modified in its native P4-P1' residues VSARM (SEQ ID NO:378) with amino acid residues for an intermediate VEGFR-2 cleavage sequence RRARM (SEQ ID NO:379), where the desired cleavage sequence in the P4-P1 positions is the VEGFR-2 cleavage sequence RRVR (SEQ ID NO:489), or with amino acid residues for the optimal t-PA cleavage sequence PFGRS (SEQ ID NO:389).

Using the methods provided herein, the following positions were identified as contributing to substrate specificity of a u-PA polypeptide: 21, 24, 30, 38, 39, 61(A), 72, 73, 75, 80, 82, 84, 89, 92, 132, 133, 137, 138, 155, 156, 158, 159, 160, 187, and 217, based on chymotrypsin numbering. Amino acid replacement or replacements can be at any one or more positions corresponding to any of the following positions F21, I24, F30, V38, T39, Y61(A), R72, L73, S75, E80, K82, E84, I89, K92, F132, G133, E137, I138, L155, K156, T158, V159, V160, K187, and R217 of a u-PA polypeptide, such as a u-PA polypeptide set forth in SEQ ID NO:433 or catalytically active portion thereof, based on chymotrypsin numbering. A modified u-PA polypeptide provided herein that exhibits increased substrate specificity can contain one or more amino acid modifications corresponding to any one or more modification of F21V, I24L, F30I, F30V, F30L, F30T, F30G, F30M, V38D, T39A, Y61(A)H, R72G, L73A, L73P, S75P, E80G, K82E, E84K, I89V, K92E, F132L, G133D, E137G, I138T, L155P, L155V, L155M, K156Y, T158A, V159A, V160A, K187E, and R217C of a u-PA polypeptide, such as a u-PA polypeptide set forth in SEQ ID NO:433 or catalytically active portion thereof, based on chymotrypsin numbering.

In one example, a modified u-PA polypeptide provided herein having increased substrate specificity for a VEGFR-2 cleavage sequence contains one or more amino acid modifications corresponding to any one or more modifications of V38D, F30I, F30T, F30L, F30V, F30G, F30M, R72G, L73A, L73P, S75P, I89V, F132L, G133D, E137G, I138T, L155P, L155V, L155M, V160A, and R217C, based on chymotrypsin numbering. Exemplary of such polypeptides are those u-PA polypeptides containing one or more amino acid modifications corresponding to any of F30I; L73A/I89V; L73P; R217C; L155P; S75P/I89V/I138T; E137G; R72G/L155P; G133D; V160A; V38D; F132L/V160A; L73A/I89V/F30T; L73A/I89V/F30L; L73A/I89V/F30V; L73A/I89V/F30G; L73A/I89V/L155V; L73A/I89V/F30M; L73A/I89V/L155M; L73A/I89V/F30L/L155M; and L73A/I89V/F30G/L155M in a u-PA polypeptide, such as a u-PA polypeptide having an amino acid sequence set forth in SEQ ID NO:433 or a catalytically active fragment thereof. Exemplary of such sequences are those set forth in any of SEQ ID NOS: 434-459, or fragments thereof of contiguous amino acids containing the mutation and having catalytic activity. In particular, modified u-PA polypeptides having the following amino acid modifications are provided: L73A/I89V; L155P; R72G/L155P; F132L/V160A; L73A/I89V/F30T; L73A/I89V/L155V; L73A/I89V/L155M; and L73A/I89V/F30L/L155M, based on chymotrypsin numbering.

In another example, a modified u-PA polypeptide provided herein having increased specificity for a cleavage sequence recognized by t-PA contains one or more amino acid modifications corresponding to any one or more modifications of F21V, I24L, F30V, F30L, T39A, Y61(A)H, E80G, K82E, E84K, I89V, K92E, K156T, T158A, V159A, and K187E, based on chymotrypsin numbering. Exemplary of such polypeptides are those u-PA polypeptides containing one or more amino acid modifications corresponding to any of F21V; I24L; F30V; F30L; F30V/Y61(A)H; F30V/K82E; F30V/K156T; F30V/K82E/V159A; F30V/K82E/T39A/V159A; F30V/Y61(A)H/K92E; F30V/K82E/V159A/E80G/I89V/K187E; and F30V/K82E/V159A/E80G/E84K/I89V/K187E, in a u-PA polypeptide, such as a u-PA polypeptide having an amino acid sequence set forth in SEQ ID NO:433 or a catalytically active fragment thereof. Exemplary of such sequences are those set forth in any of SEQ ID NOS:460-472, or fragments thereof of contiguous amino acids containing the mutation and having catalytic activity.

Also provided herein are variant proteases of the chymotrypsin family having the corresponding mutation as compared to the variant u-PA polypeptides provided herein, based on chymotrypsin numbering. For example, based on chymotrypsin numbering, modification of position F30 in u-PA corresponds to modification of position Q30 in t-PA, Q30 in trypsin, and Q30 in chymotrypsin (Bode et al. (1997) *Current Opinion in Structural Biology,* 7: 865-872). One of skill in the art could determine corresponding mutations in any other chymotrypsin family member, including but not limited to modification of any protease set forth in Table 7 and having a sequence of amino acids set forth in any of SEQ ID NOS: 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 193, 195, 197, 199, 201, 203, 205, 207, 209, 211, 213, 215, 217, 219, 221, 223, 225, 227, 229, 231, 233, 235, 237, 239, 241, 242, 243, 245, 247, 249, 251, 253, 255, 257, 259, 261, 262, 264, 266, 268, 270, 272, or catalytically active fragments thereof.

b. Variant MT-SP1 Polypeptides

In another example, variant MT-SP 1 polypeptides provided herein were selected for to have an increased reactivity for a mutant serpin polypeptide modified in its RSL sequence by replacement of the native P4-P2' reactive site amino acids with those of a desired or selected target protein. In one example, variant MT-SP 1 polypeptides were identified against selection of a modified AT3 polypeptide. Examples of modified AT3 polypeptide molecules used in the MT-SP 1 selection methods provided herein include, for example, AT3 modified in its native P4-P2' residues IAGRSL (SEQ ID NO:478) with amino acid residues for a complement protein C2 cleavage sequence SLGRKI (SEQ ID NO:479).

Using the methods provided herein, the following positions were identified as contributing to substrate specificity of an MT-SP1 polypeptide: 23, 41, 52, 60(g), 65, 71, 93, 95, 97, 98, 99, 126, 129, 131, 136, 143, 144, 154, 164, 166, 171, 173, 175, 184(a), 192, 201, 209, 217, 221(a), 230, 234, and 244 , based on chymotrypsin numbering. Amino acid replacement or replacements can be at any one or more positions corresponding to any of the following positions D23, I41, L52, Y60(g), T65, H71, F93, N95, F97, I98, F99, A126, V129, P131, I136, H143, T144, I154, N164, T166, L171, P173, Q175, F184(a), Q192, S201, Q209, D217, Q221(a), R230, F234, and V244 of an MT-SP1 polypeptide, such as full-length MT-SP1 polypeptide set forth in SEQ ID NO:253 or 515 or catalytically active portion thereof set forth in SEQ ID NO:505 or 507, based on chymotrypsin numbering. A modified MT-SP1polypeptide provided herein that exhibits increased substrate specificity can contain one or more amino acid modifications corresponding to any one or more modification of D23E, I41F, I41T, L52M, Y60(g)s, T65K, H71R, F93L, N95K, F97Y, F97L, T98P, F99L, A126T, V129D, P131S, I136T, I136V, H143R, T144I, I154V, N164D, T166A, L171F, P173S, Q175R, F184(a)L, Q192H, S201I, Q209L, D217V, Q221(a)L, R230W, F234L, and V244G of an MT-SP1 polypeptide, such as full-length MT-SP1 polypeptide set forth in SEQ ID NO:253 or 515 or catalytically active portion thereof set forth in SEQ ID NO:505 or 507, based on chymotrypsin numbering. In particular, a modified MT-SP1 polypeptide contains one or more amino acid modifications corresponding to any one or more modification of I41F, F97Y, L171F, Q175R, D217V and V244G, for example, any one or more of I41F, F97Y, L171F and V244G.

Typically, such a modified MT-SP1 polypeptide exhibits increased substrate specificity for complement protein C2. Exemplary of such polypeptides are those MT-SP1 polypeptides containing one or more amino acid modifications corresponding to any of I136T/N164D/T166A/F184(A)L/ D217V; I41F; I41F/A126T/V244G; D23E/I41F/T98P/ T144I; I41F/L171F/V244G; H143R/Q175R; I41F/L171F; R230W; I41F/I154V/244G; I41F/L52M/V129D/Q221(A)L; F99L; F97Y/I136V/Q192H/S201I; H71R/P131S/D217V; D217V; T65K/F93L/F97Y/D217V; I41T/P173S/Q209L; F97L/F234L; Q175R; N95K; and Y60(G)S in an MT-SP1 polypeptide, such as an MT-SPI polypeptide having an amino acid sequence set forth in SEQ ID NO:253 or a catalytically active fragment thereof set forth in SEQ ID NO:505. Exemplary of such sequences are those set forth in any of SEQ ID NOS:589-609, or fragments thereof of contiguous amino acids containing the mutation and having catalytic activity such as, for example, any set forth in any of SEQ ID NOS: 568-588. In some examples, the variant MT-SP1 polypeptides provided herein additionally contain a modification corresponding to C122S in an MT-SP1 polypeptide such as an MT-SP1 polypeptide having an amino acid sequence set forth in SEQ ID NO:253 or a catalytically active fragment thereof set forth in SEQ ID NO:505. Exemplary of such variant MT-SP1 polypeptides are set forth in any of SEQ ID NOS: 537-557, or fragments thereof of contiguous amino acids containing the mutation and having catalytic activity such as, for example, any set forth in any of SEQ ID NOS: 516-536.

In particular, modified u-PA polypeptides having the following amino acid modifications are provided: L73A/I89V; L155P; R72G/L155P; F132L/V160A; L73A/I89V/F30T; L73A/I89V/L155V; L73A/I89V/L155M; and L73A/I89V/ F30L/L155M, based on chymotrypsin numbering.

G. Methods of Assessing Protease Activity and Specificity

Proteases selected in the methods provided herein can be tested to determine if, following selection, the proteases retain catalytic efficiency and exhibit the desired substrate specificity. Activity assessment can be performed using supernatant from the amplified display source or from purified protein. For example, as discussed above, phage supernatant can be assayed following rescue of phage with helper phage and phage amplification. Alternatively, protease activity can be assayed directly from the cell medium or periplasm of infected bacteria. Protease activity of the purified selected protease also can be determined.

Catalytic efficiency and/or substrate specificity can be assessed by assaying for substrate cleavage using known substrates of the protease. For example, cleavage of plasminogen can be assessed in the case where t-PA or u-Pa are used in the selection method herein. In another example, a peptide substrate recognized by the protease can be used. For example, RQAR (SEQ ID NO:513), which is the autoactivation site of MT-SP1, can be used to assess the activity of selected MT-SP 1 proteases. In one embodiment, a fluorogenically tagged tetrapeptide of the peptide substrate can be used, for example, an ACC- or AMC-tetrapeptide. In addition, a fluorogenic peptide substrates designed based on the cleavage sequence of a desired target substrate for which the protease was selected against can be used to assess activity.

In some examples, the selected protease can be assessed for its activity against a known peptide substrate in the presence or absence of the variant protease trap polypeptide used in the selection method. Typically, such an activity assessment is performed in order to further select for those proteases that are inhibited in the presence of protease trap polypeptide containing the desired cleavage sequence of the target substrate, and thereby optimize for selected proteases having improved selectivity for the target substrate. Comparisons of inhibition can be made against the wild-type or template protease and/or with all other proteases identified in the selection method.

Kinetic analysis of cleavage of native substrates of a selected protease can be compared to analysis of cleavage of desired target substrates to assess specificity of the selected protease for the target sequence. In addition, second order rate constants of inhibition (ki) can be assessed to monitor the efficiency and reactivity of a selected protease for a substrate, such as for example, the protease trap polypeptide, or variant thereof, used in the selection method. Example 5 exemplifies various assays used to assess the catalytic efficiency and reactivity of mutant u-PA polypeptides identified in the methods provided herein. Example 10 and Example 12 exemplify various assays used to assess the catalytic efficiency of selected MT-S P1 phage supernatants. Example 14 exemplifies various assays used to assess the catalytic efficiency and reactivity of selected purified variant MT-SP 1 proteases.

In one example, selected proteases, such as for example selected u-PA or MT-SP1 proteases, that are selected to match the desired specificity profile of the mutated protease trap polypeptide, can be assayed using individual fluorogenic peptide substrates corresponding to the desired cleavage sequence. For example, a method of assaying for a modified protease that can cleave any one or more of the desired cleavage sequences of a target substrate includes: (a) contacting a peptide fluorogenic sample (containing a desired target cleavage sequence) with a protease, in such a manner whereby a fluorogenic moiety is released from a peptide substrate sequence upon action of the protease, thereby producing a fluorescent moiety; and (b) observing whether the sample undergoes a detectable change in fluorescence, the detectable change being an indication of the presence of the enzymatically active protease in the sample. In such an example, the desired cleavage sequence for which the protease was selected against is made into a fluorogenic peptide by methods known in the art. In one embodiment, the individual peptide cleavage sequences can be attached to a fluorogenically tagged substrate, such as for example an ACC or AMC fluorogenic leaving group, and the release of the fluorogenic moiety can be determined as a measure of specificity of a protease for a peptide cleavage sequence. The rate of increase in fluorescence of the target cleavage sequence can be measured such as by using a fluorescence spectrophotometer. The rate of increase in fluorescence can be measured over time. Michaelis-Menton kinetic constants can be determined by the standard kinetic methods. The kinetic constants $k_{cat}$, $K_m$ and $k_{cat}/K_m$ can be calculated by graphing the inverse of the substrate concentration versus the inverse of the velocity of substrate cleavage, and fitting to the Lineweaver-Burk equation $(1/velocity=(K_m/V_{max})(1/[S])+1/V_{max}$; where $V_{max}=[ET]k_{cat})$. The second order rate constant or specificity constant $(k_{cat}/K_m)$ is a measure of how well a substrate is cut by a particular protease. For example, an ACC- or AMC-tetrapeptide such as Ac-RRAR-AMC, Ac-SLGR-AMC, Ac-SLGR-ACC, Ac-RQAR-ACC, can be made and incubated with a protease selected in the methods provided herein and activity of the protease can be assessed by assaying for release of the fluorogenic moiety. The choice of the tetrapeptide depends on the desired cleavage sequence to by assayed for and can be empirically determined.

Assaying for a protease in a solution simply requires adding a quantity of the stock solution to a protease to a fluorogenic protease indicator peptide and measuring the subsequent increase in fluorescence or decrease in excitation band in the absorption spectrum. The solution and the fluorogenic indicator also can be combined and assayed in a "digestion buffer" that optimizes activity of the protease. Buffers suitable for assaying protease activity are well known to those of skill in the art. In general, a buffer is selected with a PH which corresponds to the PH optimum of the particular protease. For example, a buffer particularly suitable for assaying elastase activity contains 50 mM sodium phosphate, 1 mM EDTA at pH 8.9. The measurement is most easily made in a fluorometer, an instrument that provides an "excitation" light source for the fluorophore and then measures the light subsequently emitted at a particular wavelength. Comparison with a control indicator solution lacking the protease provides a measure of the protease activity. The activity level can be precisely quantified by generating a standard curve for the protease/indicator combination in which the rate of change in fluorescence produced by protease solutions of known activity is determined.

While detection of fluorogenic compounds can be accomplished using a fluorometer, detection can be accomplished by a variety of other methods well known to those of skill in the art. Thus, for example, when the fluorophores emit in the visible wavelengths, detection can be simply by visual inspection of fluorescence in response to excitation by a light source. Detection also can be by means of an image analysis system utilizing a video camera interfaced to a digitizer or other image acquisition system. Detection also can be by visualization through a filter, as under a fluorescence microscope. The microscope can provide a signal that is simply visualized by the operator. Alternatively, the signal can be recorded on photographic film or using a video analysis system. The signal also can simply be quantified in real time using either an image analysis system or a photometer.

Thus, for example, a basic assay for protease activity of a sample involves suspending or dissolving the sample in a buffer (at the pH optima of the particular protease being assayed) adding to the buffer a fluorogenic protease peptide indicator, and monitoring the resulting change in fluorescence using a spectrofluorometer as shown in e.g., Harris et al., (1998) *J Biol Chem* 273:27364. The spectrofluorometer is set to excite the fluorophore at the excitation wavelength of the fluorophore. The fluorogenic protease indicator is a substrate sequence of a protease that changes in fluorescence due to a protease cleaving the indicator.

Selected proteases also can be assayed to ascertain that they will cleave the desired sequence when presented in the context of the full-length protein. In one example, a purified target protein, i.e. VEGFR2 or complement protein C2, can be incubated in the presence or absence of a selected protease and the cleavage event can be monitored by SDS-PAGE followed by Coomassie Brilliant Blue staining for protein and analysis of cleavage products using densitometry. The specificity constant of cleavage of a full length protein by a protease can be determined by using gel densitometry to assess changes in densitometry over time of a full-length target substrate band incubated in the presence of a protease. In addition, the activity of the target protein also can be assayed using methods well known in the art for assaying the activity of a desired target protein, to verify that its function has been destroyed by the cleavage event.

In specific embodiments, comparison of the specificities of a selected protease, typically a modified protease, can be used to determine if the selected protease exhibits altered, for example, increased, specificity compared to the wild-type or template protease. The specificity of a protease for a target substrate can be measured by observing how many disparate sequences a modified protease cleaves at a given activity compared to a wild-type or template protease. If the modified protease cleaves fewer target substrates than the wildtype protease, the modified protease has greater specificity than the wild-type protease for those target substrates. The specificity of a protease for a target substrate can be determined from the specificity constant of cleavage of a target substrate compared to a non-target substrate (i.e. a native wildtype substrate sequence of a protease). A ratio of the specificity constants of a modified protease for a target substrate versus a non-target substrate can be made to determine a ratio of the efficiency of cleavage of the protease. Comparison of the ratio of the efficiency of cleavage between a modified protease and a wild-type or template protease can be used to assess the fold change in specificity for a target substrate. Specificity can be at least 2-fold, at least 4-fold, at least 5-fold, at least 6-fold, at least 7-fold, 8, 9, 10, 20, 30, 40, 50, 60, 70, 80, 90, 100, 200, 300, 400, 500, 600, 700, 800, 900, 1000 times or more when compared to the specificity of a wild-type or template protease for a target substrate versus a non-target substrate.

H. Methods of Producing Nucleic Acids Encoding Protease Trap Polypeptides (i.e. Serpins) or Variants Thereof or Proteases/Modified Proteases Polypeptides set forth herein, including protease trap polypeptides or protease polypeptides or catalytically active portions thereof, including modified u-PA polypeptides or modified MT-SP1 polypeptides, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a desired protease trap polypeptide or protease protein, such as from a cell or tissue source. Modified polypeptides, such as variant protease trap polypeptides or selected variant proteases, can be engineered as described herein from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences designed to facilitate protein secretion. Additional nucleotide residues sequences such as sequences of bases specifying protein binding regions also can be linked to protease-encoding nucleic acid molecules. Such regions include, but are not limited to, sequences of residues that facilitate or encode proteins that facilitate uptake of a protease into specific target cells, or otherwise alter pharmacokinetics of a product of a synthetic gene.

In addition, tags or other moieties can be added, for example, to aid in detection or affinity purification of the polypeptide. For example, additional nucleotide residues sequences such as sequences of bases specifying an epitope tag or other detectable marker also can be linked to protease-encoding nucleic acid molecules or to a serpin-encoding nucleic acid molecule, or variants thereof. Exemplary of such sequences and nucleic acid sequences encoding a His tag (e.g., 6×His, HHHHH; SEQ ID NO:496) or Flag Tag (DYKDDDDK; SEQ ID NO:495).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). The insertion into a cloning vector can, for example, be accomplished by ligating the DNA fragment into a cloning vector which has complementary cohesive termini. Insertion can be effected using TOPO cloning vectors (INVITROGEN, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for protease genes, and/or their flanking regions.

Also provided are vectors that contain a nucleic acid encoding the protease or modified protease. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the protease can be secreted into the medium.

In one embodiment, vectors containing a sequence of nucleotides that encodes a polypeptide that has protease activity, such as encoding any of the u-PA variant polypeptide provided herein, and contains all or a portion of the protease domain, or multiple copies thereof, are provided. Also provided are vectors that contain a sequence of nucleotides that encodes the protease domain and additional portions of a protease protein up to and including a full length protease protein, as well as multiple copies thereof. The vectors can be selected for expression of the modified protease protein or protease domain thereof in the cell or such that the protease protein is expressed as a secreted protein. When the protease domain is expressed, the nucleic acid is linked to a nucleic acid encoding a secretion signal, such as the *Saccharomyces cerevisiae* mating factor signal sequence or a portion thereof, or the native signal sequence.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthetase promoter (Herrar-Estrella et al., *Nature* 303:209-213 (1984)) or the cauliflower mosaic virus $^{35}$S RNA promoter (Garder et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell. Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinckert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Mogram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Sani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). For example, vectors and systems for expression of the protease domains of the protease proteins include the well known *Pichia* vectors (available, for example, from Invitrogen, San Diego, Calif.), particularly those designed for secretion of the encoded proteins. Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from NOVAGEN, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (NOVAGEN, Madison, Wis.), which contain a His-Tag™ leader sequence for use in purification with a His column and a thrombin cleavage site that permits cleavage following purification over the column, the T7-lac promoter region and the T7 terminator.

2. Expression

Proteins, such as any set forth herein including any protease trap polypeptides or variants thereof, or selected proteases or catalytically active portions thereof, can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Proteins, such as for example any variant protease provided herein or any protease trap polypeptide or variant thereof, also can be utilized or expressed as protein fusions. For example, a protease fusion can be generated to add additional functionality to a protease. Examples of protease fusion proteins include, but are not limited to, fusions of a signal sequence, a tag such as for localization, e.g. a his$_6$ tag or a myc tag, or a tag for purification, for example, a GST fusion, and a sequence for directing protein secretion and/or membrane association.

In one embodiment, a protease can be expressed in an active form. In another embodiment, a protease is expressed in an inactive, zymogen form.

a. Prokaryotic Cells

Prokaryotes, especially *E. coli*, provide a system for producing large amounts of proteins. Transformation of *E. coli* is simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreotol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as modified proteases or modified protease trap polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including modified proteases or catalytically active portions thereof, or protease trap polypeptides or variants thereof. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and poly-adenylation elements. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-$\zeta$ and Fc$_\epsilon$RI-$\gamma$ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42.)

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline syntase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteases or modified proteases (see for example, Mayfield et al. (2003) *PNAS* 100:438-442). Because plants have different glycosylation patterns than mammalian cells, this can influence the choice of protein produced in these hosts.

3. Purification Techniques

Method for purification of polypeptides, including protease polypeptides or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

In one example, proteases can be expressed and purified to be in an inactive form (zymogen form) or alternatively the expressed protease can be purified into an active form, such as a two-chain form, by autocatalysis to remove the proregion. Typically, the autoactivation occurs during the purification process, such as by incubating at room temperature for 24-72 hours. The rate and degree of activation is dependent on protein concentration and the specific modified protease, such that for example, a more dilute sample can need to be incubated at room temperature for a longer period of time. Activation can be monitored by SDS-PAGE (e.g., a 3 kilodalton shift) and by enzyme activity (cleavage of a fluorogenic substrate). Typically, a protease is allowed to achieve >75% activation before purification.

Proteins, such as proteases or protease-trap polypeptides, can be purified using standard protein purification techniques known in the art including but not limited to, SDS-PAGE, size fraction and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind proteases or protease trap polypeptides can be used in affinity purification. Expression constructs also can be engineered to add an affinity tag to a protein such as a myc epitope, GST fusion or His$_6$ and affinity purified with myc antibody, glutathione resin and Ni-resin, respectively. Purity can be assessed by any method known in the art including gel electrophoresis and staining and spectrophotometric techniques.

4. Fusion Proteins

Fusion proteins containing a variant protease provided herein and one or more other polypeptides also are provided. Pharmaceutical compositions containing such fusion proteins formulated for administration by a suitable route are provided. Fusion proteins are formed by linking in any order the modified protease and another polypeptide, such as an antibody or fragment thereof, growth factor, receptor, ligand and other such agent for the purposes of facilitating the purification of a protease, altering the pharmacodynamic properties of a protease by directing the protease to a targeted cell or tissue, and/or increasing the expression or secretion of a protease. Within a protease fusion protein, the protease polypeptide can correspond to all or a catalytically active portion thereof of a protease protein. In some embodiments, the protease or catalytically active portion thereof is a modified protease. Fusion proteins provided herein retain substantially all of their specificity and/or selectivity for any one or more of the desired target substrates. Generally, protease fusion polypeptides retain at least about 30%, 40%, 50%, 60%, 70%, 80%, 85%, 90% or 95% substrate specificity and/or selectivity compared with a non-fusion protease, including 96%, 97%, 98%, 99% or greater substrate specificity compared with a non-fusion protease.

Linkage of a protease polypeptide and another polypeptide can be effected directly or indirectly via a linker. In one example, linkage can be by chemical linkage, such as via heterobifunctional agents or thiol linkages or other such linkages. Fusion of a protease to another polypeptide can be to the N- or C-terminus of the protease polypeptide. Non-limiting examples of polypeptides that can be used in fusion proteins with a protease provided herein include, for example, a GST (glutathione S-transferase) polypeptide, Fc domain from an immunoglobulin, or a heterologous signal sequence. The fusion proteins can contain additional components, such as $E.$ $coli$ maltose binding protein (MBP) that aid in uptake of the protein by cells (see, International PCT application No. WO 01/32711).

A protease fusion protein can be produced by standard recombinant techniques. For example, DNA fragments coding for the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). A protease-encoding nucleic acid can be cloned into such an expression vector such that the fusion moiety is linked in-frame to the protease protein.

5. Nucleotide Sequences

Nucleic acid molecules encoding modified proteases are provided herein. Nucleic acid molecules include allelic variants or splice variants of any encoded protease, or catalytically active portion thereof. In one embodiment, nucleic acid molecules provided herein have at least 50, 60, 65, 70, 75, 80, 85, 90, 91, 92, 93, 94, 95, or 99% sequence identity or hybridize under conditions of medium or high stringency along at least 70% of a full-length of any nucleic acid encoded wild-type protease, or catalytically active portion thereof. In another embodiment, a nucleic acid molecule can include those with degenerate codon sequences of any of the proteases or catalytically active portions thereof such as those provided herein.

Nucleic acid molecules, or fusion proteins containing a catalytically active portion of a nucleic acid molecule, operably-linked to a promoter, such as an inducible promoter for expression in mammalian cells also are provided. Such promoters include, but are not limited to, CMV and SV40 promoters; adenovirus promoters, such as the E2 gene promoter, which is responsive to the HPV E7 oncoprotein; a PV promoter, such as the PBV p89 promoter that is responsive to the PV E2 protein; and other promoters that are activated by the HIV or PV or oncogenes.

Modified proteases provided herein, also can be delivered to the cells in gene transfer vectors. The transfer vectors also can encode additional other therapeutic agent(s) for treatment of the disease or disorder, such as coagulation disorders or cancer, for which the protease is administered. Transfer vectors encoding a protease can be used systemically, by administering the nucleic acid to a subject. For example, the transfer vector can be a viral vector, such as an adenovirus vector. Vectors encoding a protease also can be incorporated into stem cells and such stem cells administered to a subject such as by transplanting or engrafting the stem cells at sites for therapy. For example, mesenchymal stem cells (MSCs) can be engineered to express a protease and such MSCs engrafted at a tumor site for therapy.

I. Preparation, Formulation and Administration of Selected Protease Polypeptides

1. Compositions and Delivery

Compositions of selected proteases, such as for example selected mutant u-PA polypeptides, can be formulated for administration by any route known to those of skill in the art including intramuscular, intravenous, intradermal, intraperitoneal injection, subcutaneous, epidural, nasal, oral, rectal, topical, inhalational, buccal (e.g., sublingual), and transdermal administration or any route. Selected proteases can be administered by any convenient route, for example by infusion or bolus injection, by absorption through epithelial or mucocutaneous linings (e.g., oral mucosa, rectal and intestinal mucosa, etc.) and can be administered with other biologically active agents, either sequentially, intermittently or in the same composition. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Administration also can include controlled release systems including controlled release formulations and device controlled release, such as by means of a pump. The most suitable route in any given case depends on a variety of factors, such as the nature of the disease, the progress of the disease, the severity of the disease the particular composition which is used.

Various delivery systems are known and can be used to administer selected proteases, such as but not limited to, encapsulation in liposomes, microparticles, microcapsules, recombinant cells capable of expressing the compound, receptor mediated endocytosis, and delivery of nucleic acid molecules encoding selected proteases such as retrovirus delivery systems.

Pharmaceutical compositions containing selected proteases can be prepared. Generally, pharmaceutically acceptable compositions are prepared in view of approvals for a regulatory agency or other agency prepared in accordance with generally recognized pharmacopeia for use in animals and in humans. Pharmaceutical compositions can include carriers such as a diluent, adjuvant, excipient, or vehicle with which an isoform is administered. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acaciagelatin, glucose, molasses, polyinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, cyclodextrine derivatives, sorbitan monolaurate, triethanolamine sodium acetate, triethanolamine oleate, and other such agents. These compositions can take the form of solutions, suspensions, emulsion, tablets, pills, capsules, powders, and sustained release formulations. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to the patient. The formulation should suit the mode of administration.

Formulations are provided for administration to humans and animals in unit dosage forms, such as tablets, capsules, pills, powders, granules, sterile parenteral solutions or suspensions, and oral solutions or suspensions, and oil water emulsions containing suitable quantities of the compounds or pharmaceutically acceptable derivatives thereof. Pharmaceutically therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Examples of unit dose forms include ampoules and syringes and individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging.

Dosage forms or compositions containing active ingredient in the range of 0.005% to 100% with the balance made up from non-toxic carrier can be prepared. For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well-known in the art.

Pharmaceutical preparation also can be in liquid form, for example, solutions, syrups or suspensions, or can be presented as a drug product for reconstitution with water or other suitable vehicle before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid).

Formulations suitable for rectal administration can be provided as unit dose suppositories. These can be prepared by admixing the active compound with one or more conventional solid carriers, for example, cocoa butter, and then shaping the resulting mixture.

Formulations suitable for topical application to the skin or to the eye include ointments, creams, lotions, pastes, gels, sprays, aerosols and oils. Exemplary carriers include vaseline, lanoline, polyethylene glycols, alcohols, and combinations of two or more thereof. The topical formulations also can contain 0.05 to 15, 20, 25 percent by weight of thickeners selected from among hydroxypropyl methyl cellulose, methyl cellulose, polyvinylpyrrolidone, polyvinyl alcohol, poly(alkylene glycols), poly/hydroxyalkyl, (meth)acrylates or poly(meth)acrylamides. A topical formulation is often applied by instillation or as an ointment into the conjunctival sac. It also can be used for irrigation or lubrication of the eye, facial sinuses, and external auditory meatus. It also can be injected into the anterior eye chamber and other places. A topical formulation in the liquid state also can be present in a hydrophilic three-dimensional polymer matrix in the form of a strip or contact lens, from which the active components are released.

For administration by inhalation, the compounds for use herein can be delivered in the form of an aerosol spray presentation from pressurized packs or a nebulizer, with the use of a suitable propellant, e.g., dichlorodifluoromethane, trichlorofluoromethane, dichlorotetrafluoroethane, carbon dioxide or other suitable gas. In the case of a pressurized aerosol, the dosage unit can be determined by providing a valve to deliver a metered amount. Capsules and cartridges of, e.g., gelatin, for use in an inhaler or insufflator can be formulated containing a powder mix of the compound and a suitable powder base such as lactose or starch.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Pharmaceutical compositions of selected proteases can be formulated for parenteral administration by injection, e.g., by bolus injection or continuous infusion. Formulations for injection can be presented in unit dosage form, e.g., in ampules or in multi-dose containers, with an added preservative. The compositions can be suspensions, solutions or emulsions in oily or aqueous vehicles, and can contain formulatory agents such as suspending, stabilizing and/or dispersing agents. Alternatively, the active ingredient can be in powder form for reconstitution with a suitable vehicle, e.g., sterile pyrogen-free water or other solvents, before use.

Formulations suitable for transdermal administration are provided. They can be provided in any suitable format, such as discrete patches adapted to remain in intimate contact with the epidermis of the recipient for a prolonged period of time. Such patches contain the active compound in optionally buffered aqueous solution of, for example, 0.1 to 0.2M concentration with respect to the active compound. Formulations suitable for transdermal administration also can be delivered by iontophoresis (see, e.g., *Pharmaceutical Research* 3(6), 318 (1986)) and typically take the form of an optionally buffered aqueous solution of the active compound.

Pharmaceutical compositions also can be administered by controlled release formulations and/or delivery devices (see, e.g., in U.S. Pat. Nos. 3,536,809; 3,598,123; 3,630,200; 3,845,770; 3,847,770; 3,916,899; 4,008,719; 4,687,610; 4,769,027; 5,059,595; 5,073,543; 5,120,548; 5,354,566; 5,591,767; 5,639,476; 5,674,533 and 5,733,566).

In certain embodiments, liposomes and/or nanoparticles also can be employed with selected protease administration. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 µm. Sonication of MLVs results in the formation of small unilamellar vesicles (SUVs) with diameters in the range of 200 to 500 angstroms containing an aqueous solution in the core.

Phospholipids can form a variety of structures other than liposomes when dispersed in water, depending on the molar ratio of lipid to water. At low ratios, the liposomes form. Physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 µm) should be designed using polymers able to be degraded in vivo. Biodegradable polyalkyl-cyanoacrylate nanoparticles that meet these requirements are contemplated for use herein, and such particles can be easily made.

Administration methods can be employed to decrease the exposure of selected proteases to degradative processes, such as proteolytic degradation and immunological intervention via antigenic and immunogenic responses. Examples of such methods include local administration at the site of treatment. Pegylation of therapeutics has been reported to increase resistance to proteolysis, increase plasma half-life, and decrease antigenicity and immunogenicity. Examples of pegylation methodologies are known in the art (see for example, Lu and Felix, *Int. J. Peptide Protein Res.,* 43: 127-138, 1994; Lu and Felix, *Peptide Res.,* 6: 142-6, 1993; Felix et al., *Int. J. Peptide Res.,* 46: 253-64, 1995; Benhar et al., *J. Biol. Chem.,* 269: 13398-404, 1994; Brumeanu et al., *J Immunol.,* 154: 3088-95, 1995; see also, Caliceti et al. (2003) *Adv. Drug Deliv. Rev.* 55(10):1261-77 and Molineux (2003) *Pharmacotherapy* 23 (8 Pt 2):3S-8S). Pegylation also can be used in the delivery of nucleic acid molecules in vivo. For example, pegylation of adenovirus can increase stability and gene transfer (see, e.g., Cheng et al. (2003) *Pharm. Res.* 20(9): 1444-51).

Desirable blood levels can be maintained by a continuous infusion of the active agent as ascertained by plasma levels. It should be noted that the attending physician would know how to and when to terminate, interrupt or adjust therapy to lower dosage due to toxicity, or bone marrow, liver or kidney dysfunctions. Conversely, the attending physician would also know how to and when to adjust treatment to higher levels if the clinical response is not adequate (precluding toxic side effects).

Pharmaceutical compositions can be administered, for example, by oral, pulmonary, parental (intramuscular, intraperitoneal, intravenous (IV) or subcutaneous injection), inhalation (via a fine powder formulation), transdermal, nasal, vaginal, rectal, or sublingual routes of administration and can be formulated in dosage forms appropriate for each route of administration (see, e.g., International PCT application Nos. WO 93/25221 and WO 94/17784; and European Patent Application 613,683).

A selected protease is included in the pharmaceutically acceptable carrier in an amount sufficient to exert a therapeutically useful effect in the absence of undesirable side effects on the patient treated. Therapeutically effective concentration can be determined empirically by testing the compounds in known in vitro and in vivo systems, such as the assays provided herein.

The concentration of a selected protease in the composition depends on absorption, inactivation and excretion rates of the complex, the physicochemical characteristics of the complex, the dosage schedule, and amount administered as well as other factors known to those of skill in the art. The amount of a selected protease to be administered for the treatment of a disease or condition, for example cancer or angiogenesis treatment can be determined by standard clinical techniques. In addition, in vitro assays and animal models can be employed to help identify optimal dosage ranges. The precise dosage, which can be determined empirically, can depend on the route of administration and the seriousness of the disease.

A selected protease can be administered at once, or can be divided into a number of smaller doses to be administered at intervals of time. Selected proteases can be administered in one or more doses over the course of a treatment time for example over several hours, days, weeks, or months. In some cases, continuous administration is useful. It is understood that the precise dosage and duration of treatment is a function of the disease being treated and can be determined empirically using known testing protocols or by extrapolation from in vivo or in vitro test data. It is to be noted that concentrations and dosage values also can vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered hourly, daily, weekly, monthly, yearly or once. The mode of administration of the composition containing the polypeptides as well as compositions containing nucleic acids for gene therapy, includes, but is not limited to intralesional, intraperitoneal, intramuscular and intravenous administration. Also included are infusion, intrathecal, subcutaneous, liposome-mediated, depot-mediated administration. Also included, are nasal, ocular, oral, topical, local and otic delivery. Dosages can be empirically determined and depend upon the indication, mode of administration and the subject. Exemplary dosages include from 0.1, 1, 10, 100, 200 and more mg/day/kg weight of the subject.

2. In vivo Expression of Selected Proteases and Gene Therapy

Selected proteases can be delivered to cells and tissues by expression of nucleic acid molecules. Selected proteases can be administered as nucleic acid molecules encoding a selected protease, including ex vivo techniques and direct in vivo expression.

a. Delivery of Nucleic Acids

Nucleic acids can be delivered to cells and tissues by any method known to those of skill in the art.

i. Vectors—Episomal and Integrating

Methods for administering selected proteases by expression of encoding nucleic acid molecules include administration of recombinant vectors. The vector can be designed to remain episomal, such as by inclusion of an origin of replication or can be designed to integrate into a chromosome in the cell. Recombinant vectors can include viral vectors and non-viral vectors. Non-limiting viral vectors include, for example, adenoviral vector, herpes virus vectors, retroviral vectors, and any other viral vector known to one of skill in the art. Non-limiting non-viral vectors include artificial chromosomes or liposomes or other non-viral vector. Selected proteases also can be used in ex vivo gene expression therapy using viral and non-viral vectors. For example, cells can be engineered to express a selected protease, such as by integrating a selected protease encoding-nucleic acid into a genomic location, either operatively linked to regulatory sequences or such that it is placed operatively linked to regulatory sequences in a genomic location. Such cells then can be administered locally or systemically to a subject, such as a patient in need of treatment.

A selected protease can be expressed by a virus, which is administered to a subject in need of treatment. Virus vectors suitable for gene therapy include adenovirus, adeno-associated virus, retroviruses, lentiviruses and others noted above. For example, adenovirus expression technology is well-known in the art and adenovirus production and administration methods also are well known. Adenovirus serotypes are available, for example, from the American Type Culture Collection (ATCC, Rockville, Md.). Adenovirus can be used ex vivo, for example, cells are isolated from a patient in need of treatment, and transduced with a selected protease-expressing adenovirus vector. After a suitable culturing period, the transduced cells are administered to a subject, locally and/or systemically. Alternatively, selected protease-expressing adenovirus particles are isolated and formulated in a pharmaceutically-acceptable carrier for delivery of a therapeutically effective amount to prevent, treat or ameliorate a disease or condition of a subject. Typically, adenovirus particles are delivered at a dose ranging from 1 particle to 1014 particles per kilogram subject weight, generally between 106 or 108 particles to 1012 particles per kilogram subject weight. In some situations it is desirable to provide a nucleic acid source with an agent that targets cells, such as an antibody specific for a cell surface membrane protein or a target cell, or a ligand for a receptor on a target cell.

ii. Artificial Chromosomes and Other Non-Viral Vector Delivery Methods

The nucleic acid molecules can be introduced into artificial chromosomes and other non-viral vectors. Artificial chromosomes (see, e.g., U.S. Pat. No. 6,077,697 and PCT International PCT application No. WO 02/097059) can be engineered to encode and express the isoform.

iii. Liposomes and Other Encapsulated Forms and Administration of Cells Containing Nucleic Acids The nucleic acids can be encapsulated in a vehicle, such as a liposome, or introduced into cells, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, e.g. capsid proteins or fragments thereof tropic for a particular cell type, antibodies for proteins which undergo internalization in cycling, and proteins that target intracellular localization and enhance intracellular half-life.

b. In Vitro and Ex vivo Delivery

For ex vivo and in vivo methods, nucleic acid molecules encoding the selected protease is introduced into cells that are from a suitable donor or the subject to be treated. Cells into which a nucleic acid can be introduced for purposes of therapy include, for example, any desired, available cell type appropriate for the disease or condition to be treated, including but not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., such as stem cells obtained from bone marrow, umbilical cord blood, peripheral blood, fetal liver, and other sources thereof.

For ex vivo treatment, cells from a donor compatible with the subject to be treated, or cells from the subject to be treated, are removed, the nucleic acid is introduced into these isolated cells and the modified cells are administered to the subject. Treatment includes direct administration, such as or, for example, encapsulated within porous membranes, which are implanted into the patient (see, e.g. U.S. Pat. Nos. 4,892,538 and 5,283,187). Techniques suitable for the transfer of nucleic acid into mammalian cells in vitro include the use of liposomes and cationic lipids (e.g., DOTMA, DOPE and DC-Chol) electroporation, microinjection, cell fusion, DEAE-dextran, and calcium phosphate precipitation methods. Methods of DNA delivery can be used to express selected proteases in vivo. Such methods include liposome delivery of nucleic acids and naked DNA delivery, including local and systemic delivery such as using electroporation, ultrasound and calcium-phosphate delivery. Other techniques include microinjection, cell fusion, chromosome-mediated gene transfer, microcell-mediated gene transfer and spheroplast fusion.

In vivo expression of a selected protease can be linked to expression of additional molecules. For example, expression of a selected protease can be linked with expression of a cytotoxic product such as in an engineered virus or expressed in a cytotoxic virus. Such viruses can be targeted to a particular cell type that is a target for a therapeutic effect. The expressed selected protease can be used to enhance the cytotoxicity of the virus.

In vivo expression of a selected protease can include operatively linking a selected protease encoding nucleic acid molecule to specific regulatory sequences such as a cell-specific or tissue-specific promoter. Selected proteases also can be expressed from vectors that specifically infect and/or replicate in target cell types and/or tissues. Inducible promoters can be used to selectively regulate selected protease expression.

c. Systemic, Local and Topical Delivery

Nucleic acid molecules, as naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell.

Administration also can be direct, such as by administration of a vector or cells that typically targets a cell or tissue. For example, tumor cells and proliferating cells can be targeted cells for in vivo expression of selected proteases. Cells used for in vivo expression of an isoform also include cells autologous to the patient. Such cells can be removed from a patient, nucleic acids for expression of a selected protease introduced, and then administered to a patient such as by injection or engraftment.

2. Combination Therapies

Any of the selected protease polypeptides, and nucleic acid molecules encoding selected protease polypeptides described herein can be administered in combination with, prior to, intermittently with, or subsequent to, other therapeutic agents or procedures including, but not limited to, other biologics, small molecule compounds and surgery. For any disease or condition, including all those exemplified above, for which other agents and treatments are available, selected protease polypeptides for such diseases and conditions can be used in combination therewith. For example, selected protease polypeptides provided herein for the treatment of a proliferative disease for example, cancer, can be administered in combination with, prior to, intermittently with, or subsequent to, other anti-cancer therapeutic agents, for example chemotherapeutic agents, radionuclides, radiation therapy, cytokines, growth factors, photosensitizing agents, toxins, antimetabolites, signaling modulators, anti-cancer antibiotics, anti-cancer antibodies, angiogenesis inhibitors, or a combination thereof. In a specific example, selected protease polypeptides provided herein for the treatment of thrombotic diseases can be administered in combination with, prior to, intermittently with, or subsequent to, other anticoagulant agents including, but not limited to, platelet inhibitors, vasodilators, fibrolytic activators, or other anticoagulants. Exemplary anticoagulants include heparin, coumarin, hirudin, aspirin, naproxen, meclofenamic acid, ibuprofen, indomethacin, phenylbutazare, ticlopidine, streptokinase, urokinase, and tissue plasminogen activator.

3. Articles of Manufacture and Kits

Pharmaceutical compounds of selected protease polypeptides for nucleic acids encoding selected protease polypeptides, or a derivative or a biologically active portion thereof can be packaged as articles of manufacture containing packaging material, a pharmaceutical composition which is effective for treating the disease or disorder, and a label that indicates that selected protease polypeptide or nucleic acid molecule is to be used for treating the disease or disorder.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any target-mediated disease or disorder.

Selected protease polypeptides and nucleic acid molecules also can be provided as kits. Kits can include a pharmaceutical composition described herein and an item for administration. For example a selected protease can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of the selected protease in a subject.

J. Exemplary Methods of Treatment with Selected Protease Polypeptides

The selected protease polypeptides provided herein that cleave particular targets and nucleic acid molecules that encode the selected proteases provided herein can be used for treatment of any disease or condition associated with a protein containing the target sequence or for which a protease that cleaves the target sequence is employed. For example, selected uPA polypeptides engineered to cleave tPA target substrates, such as plasminogen, can be used for treatment of any disease or condition associated with the tPA target substrate or for which tPA polypeptides are employed. Exemplary diseases associated with a tPA target substrate include thrombolytic diseases where treatment with a selected protease provided herein can promote cleavage of plasminogen to its active protease form plasmin, and induce dissolution of a blot clot.

Selected protease polypeptides have therapeutic activity alone or in combination with other agents. The selected protease polypeptides provided herein are designed to exhibit improved properties over competing binding proteins. Such properties, for example, can improve the therapeutic effectiveness of the polypeptides. This section provides exemplary uses of and administration methods. These described therapies are exemplary and do not limit the applications of selected protease polypeptides.

The selected protease polypeptides provided herein can be used in various therapeutic as well as diagnostic methods that are associated with a protein containing the target sequence. Such methods include, but are not limited to, methods of treatment of physiological and medical conditions described and listed below. Selected protease polypeptides provided herein can exhibit improvement of in vivo activities and therapeutic effects compared to competing binding proteins or a protease that cleaves the particular target, including lower dosage to achieve the same effect, a more sustained therapeutic effect and other improvements in administration and treatment. Examples of therapeutic improvements using selected protease polypeptides include, but are not limited to, better target tissue penetration (e.g. tumor penetration), higher effectiveness, lower dosages, fewer and/or less frequent administrations, decreased side effects and increased therapeutic effects. Notably, because the selected proteases can cleave and inactivate high numbers of the target substrate, the selected proteases offer substantial therapeutic amplification.

In particular, selected protease polypeptides, are intended for use in therapeutic methods in which a protease that cleaves the particular target has been used for treatment. Such methods include, but are not limited to, methods of treatment of diseases and disorders, such as, but not limited to, blood coagulation disorders, including thrombolytic disorders and disseminated intravascular coagulation, cardiovascular diseases, neurological disorders, proliferative diseases, such as cancer, inflammatory diseases, autoimmune diseases, viral infection, bacterial infection, respiratory diseases, gastrointestinal disorders, and metabolic diseases.

Treatment of diseases and conditions with selected protease polypeptides can be effected by any suitable route of administration using suitable formulations as described herein including, but not limited to, intramuscular, intravenous, intradermal, intraperitoneal injection, subcutaneous, epidural, nasal oral, rectal, topical, inhalational, buccal (e.g., sublingual), and transdermal administration. If necessary, a particular dosage and duration and treatment protocol can be empirically determined or extrapolated. For example, exemplary doses of wild-type protease polypeptides that cleave similar sequences can be used as a starting point to determine appropriate dosages. For example, a dosage of a recombinant tPA polypeptide can be used as a guideline for determining dosages of selected uPA polypeptides that cleave tPA targets.

Dosage levels and regimens can be determined based upon known dosages and regimens, and, if necessary can be extrapolated based upon the changes in properties of the selected protease polypeptides and/or can be determined empirically based on a variety of factors. Factors such as the level of activity and half-life of the selected protease polypeptides in comparison to other similar proteases can be used in making such determinations. Particular dosages and regimens can be empirically determined. Other such factors include body weight of the individual, general health, age, the activity of the specific compound employed, sex, diet, time of administration, rate of excretion, drug combination, the severity and course of the disease, and the patient's disposition to the disease and the judgment of the treating physician. The active ingredient, the selected protease polypeptide, typically is combined with a pharmaceutically effective carrier. The amount of active ingredient that can be combined with the carrier materials to produce a single dosage form or multi-dosage form can vary depending upon the host treated and the particular mode of administration.

The effect of the selected protease polypeptides on the treatment of a disease or amelioration of symptoms of a disease can be monitored using any diagnostic test known in the art for the particular disease to be treated. Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms or based upon scheduled dosages. In other cases, additional administrations can be required in response to acute events such as hemorrhage, trauma, or surgical procedures.

In some examples, variants of the selected protease proteins that function as either protease agonists (i.e., mimetics) or as protease antagonists are employed. Variants of the selected protease polypeptide can be generated by mutagenesis (e.g., discrete point mutation or truncation of the protease protein). An agonist of the selected protease polypeptide can retain substantially the same, or a subset of, the biological activities of the naturally occurring form of the selected protease polypeptide. An antagonist of the selected protease polypeptide can inhibit one or more of the activities of the naturally occurring form of the selected protease polypeptide by, for example, cleaving the same target protein as the selected protease polypeptide. Thus, specific biological effects can be elicited by treatment with a variant of limited function. In one embodiment, treatment of a subject with a variant having a subset of the biological activities of the naturally occurring form of the selected protease polypeptide has fewer side effects in a subject relative to treatment with the naturally occurring form of the selected protease polypeptide.

The following are some exemplary diseases or conditions for which selected proteases can be used as a treatment agent alone or in combination with other agents. Exemplary targets for selection of proteases are for illustrative purposes and not intended to limit the scope of possible targets for use in the methods provided herein.

1. Exemplary Methods of Treatment for Selected uPA Polypeptides that Cleave tPA Targets Selected uPA polypeptides that cleave tPA target sequences are useful in therapeutic applications for use in ameliorating thrombotic disorders including both acute and chronic conditions. Acute conditions include among others both heart attack and stroke while chronic situations include those of arterial and deep vein thrombosis and restenosis. The selected uPA polypeptides can be used as thrombolytic therapeutic agents for ameliorating the symptoms of such conditions. Therapeutic compositions include the polypeptides, cDNA molecules alone or part of a viral vector delivery system or other vector-based gene expression delivery system, presented in a liposome delivery system and the like. A composition for use as a thrombolytic therapeutic agent generally is a physiologically effective amount of the selected uPA polypeptides in a pharmaceutically suitable excipient. Depending on the mode of administration and the condition to be treated, the thrombolytic therapeutic agents are administered in single or multiple doses. One skilled in the art will appreciate that variations in dosage depend on the condition to be treated.

Selected uPA polypeptides provided herein that inhibit or antagonize blood coagulation can be used in anticoagulant methods of treatment for ischemic disorders, such as a peripheral vascular disorder, a pulmonary embolus, a venous thrombosis, deep vein thrombosis (DVT), superficial thrombophlebitis (SVT), arterial thrombosis, a myocardial infarction, a transient ischemic attack, unstable angina, a reversible ischemic neurological deficit, an adjunct thrombolytic activity, excessive clotting conditions, reperfusion injury, sickle cell anemia or stroke disorder. In patients with an increased risk of excessive clotting, such as DVT or SVT, during surgery, protease inactive selected uPA polypeptides provided herein can be administered to prevent excessive clotting in surgeries, such as, but not limited to heart surgery, angioplasty, lung surgery, abdominal surgery, spinal surgery, brain surgery, vascular surgery, or organ transplant surgery, including transplantation of heart, lung, pancreas, or liver. In some cases treatment is performed with selected uPA polypeptides alone. In some cases, selected uPA polypeptides are administered in conjunction with additional anticoagulation factors as required by the condition or disease to be treated.

tPA is the only therapy for acute thromboembolic stroke, which is approved by the Food and Drug Administration (FDA). tPA and variants thereof are commercially available and have been approved for administration to humans for a variety of conditions. For example alteplase (Activase®, Genentech, South San Francisco, Calif.) is recombinant human tPA. Reteplase (Retavase®, Rapilysin®; Boehringer Mannheim, Roche Centoror) is a recombinant non-glycosylated form of human tPA in which the molecule has been genetically engineered to contain 355 of the 527 amino acids of the original protein. Tenecteplase (TNKase®, Genentech) is a 527 amino acid glycoprotein derivative of human tPA that differs from naturally occurring human tPA by having three amino acid substitutions. These substitutions decrease plasma clearance, increase fibrin binding (and thereby increase fibrin specificity), and increase resistance to plasminogen activator inhibitor-1 (PAI-1). Anistreplase (Eminase®, SmithKline Beecham) is yet another commercially available human tPA. Selected uPA polypeptides provided herein with specificity toward tPA targets can be similarly modified and prescribed for any therapy that is treatable with tPA.

a. Thrombotic Diseases and Conditions

Thrombotic diseases are characterized by hypercoagulation, or the deregulation of hemostasis in favor of development of blot clots. Exemplary thrombotic diseases and conditions include arterial thrombosis, venous thrombosis, venous thromboembolism, pulmonary embolism, deep vein thrombosis, stroke, ischemic stroke, myocardial infarction, unstable angina, atrial fibrillation, renal damage, percutaneous transluminal coronary angioplasty, disseminated intravascular coagulation, sepsis, artificial organs, shunts or prostheses, and other acquired thrombotic diseases, as discussed below. Typical therapies for thrombotic diseases involve anticoagulant therapies, including inhibition of the coagulation cascade.

The selected uPA polypeptides provided herein and the nucleic acids encoding the selected uPA polypeptides provided herein can be used in anticoagulant therapies for thrombotic diseases and conditions, including treatment of conditions involving intravascular coagulation. The selected uPA polypeptides provided herein the can inhibit blood coagulation can be used, for example, to control, dissolve, or prevent formation of thromboses. In a particular embodiment, the selected uPA polypeptides herein, and nucleic acids encoding selected uPA polypeptides can be used for treatment of an arterial thrombotic disorder. In another embodiment, the selected uPA polypeptides herein, and nucleic acids encoding modified selected uPA polypeptides can be used for treatment of a venous thrombotic disorder, such as deep vein thrombosis. In a particular embodiment, the selected uPA polypeptides herein, and nucleic acids encoding selected uPA polypeptides can be used for treatment of an ischemic disorder, such as stroke. Examples of therapeutic improvements using selected uPA polypeptides include for example, but are not limited to, lower dosages, fewer and/or less frequent administrations, decreased side effects, and increased therapeutic effects. Selected uPA polypeptides can be tested for therapeutic effectiveness, for example, by using animal models. For example mouse models of ischemic stroke, or any other known disease model for a thrombotic disease or condition, can be treated with selected uPA polypeptides (Dodds, *Ann NY Acad Sci* 516: 631-635 (1987)). Progression of disease symptoms and phenotypes is monitored to assess the effects of the selected uPA polypeptides. Selected uPA polypeptides also can be administered to animal models as well as subjects such as in clinical trials to assess in vivo effectiveness in comparison to placebo controls.

i. Arterial Thrombosis

Arterial thrombi form as a result of a rupture in the arterial vessel wall. Most often the rupture occurs in patients with vascular disease, such as atherosclerosis. The arterial thrombi usually form in regions of disturbed blood flow and at sites of rupture due to an atherosclerotic plaque, which exposes the thrombogenic subendothelium to platelets and coagulation proteins, which in turn activate the coagulation cascade. Plaque rupture also can produce further narrowing of the blood vessel due to hemorrhage into the plaque. Nonocclusive thrombi can become incorporated into the vessel wall and can accelerate the growth of atherosclerotic plaques. Formation arterial thrombi can result in ischemia either by obstructing flow or by embolism into the distal microcirculation. Anticoagulants and drugs that suppress platelet function and the coagulation cascade can be effective in the prevention and treatment of arterial thrombosis. Such classes of drugs are effective in the treatment of arterial thrombosis. Arterial thrombosis can lead to conditions of unstable angina and acute myocardial infarction. Selected uPA polypeptides provided herein that inhibit coagulation can be used in the treatment and/or prevention of arterial thrombosis and conditions, such as unstable angina and acute myocardial infarction.

ii. Venous Thrombosis and Thromboembolism

Venous thrombosis is a condition in which a blood clot forms in a vein due to imbalances in the signals for clot formation versus clot dissolution, especially in instances of low blood flow through the venous system. Results of thrombus formation can include damage to the vein and valves of the vein, though the vessel wall typically remains intact. The clots can often embolize, or break off, and travel through the blood stream where they can lodge into organ areas such as the lungs (pulmonary embolism), brain (ischemic stroke, transient ischemic attack), heart (heart attack/myocardial infarction, unstable angina), skin (purpura fulminans), and adrenal gland. In some instances the blockage of blood flow can lead to death. Patients with a tendency to have recurrent venous thromboembolism are characterized as having thrombophilia. Risk factors for developing thromboembolic disease include trauma, immobilization, malignant disease, heart failure, obesity, high levels of estrogens, leg paralysis, myocardial infarction, varicose veins, cancers, dehydration, smoking, oral contraceptives, and pregnancy. Genetic studies of families with thrombophilia have shown inheritable high levels coagulation factors, including FVIII, FIX, and FXI (Lavigne et al. *J. Thromb. Haemost.* 1:2134-2130 (2003)).

Deep vein thrombosis (DVT) refers the formation of venous blot clot in the deep leg veins. The three main factors that contribute to DVT are injury to the vein lining, increased tendency for the blood to clot and slowing of blood flow. Collectively, these factor are called Virchow's triad. Veins can become injured during trauma or surgery, or as a result of disease condition, such as Buerger's disease or DIC, or another clot. Other contributing factors to development of DVT are similar to that of more general thromboembolic diseases as discussed above. The clot that forms in DVT causes only minor inflammation, thus, allowing it to break loose into the blood stream more easily. Often the thrombus can break off as a result of minor contraction of the leg muscles. Once the thrombus becomes an embolus it can become lodged into vessels of the lungs where is can cause a pulmonary infarction. Patients with high levels of active FIX in their bloodstream are at an increased risk of developing deep vein thrombosis (Weltermann et al. *J. Thromb. Haemost.* 1(1): 16-18 (2003)).

Thromboembolic disease can be hereditary, wherein the disease is caused by hereditary abnormalities in clotting factors, thus leading to the imbalance in hemostasis. Several congenital deficiencies include antithrombin III, protein C, protein S, or plasminogen. Other factors include resistance to activated protein C (also termed APC resistance or Factor V leiden effect, in which a mutation in factor V makes it resistant to degradation by protein C), mutation in prothrombin, dysfibrinogemia (mutations confer resistance to fibrinolysis), and hyperhomocysteinemia. Development of thromboembolic disease in younger patients is most often due to the congenital defects described above and is called Juvenile Thrombophilia.

Treatments for venous thromboembolic disease and DVT typically involve anticoagulant therapy, in which oral doses of heparin and warfarin are administered. Heparin is usually infused into patients to control acute events, followed by longer term oral anticoagulant therapy with warfarin to control future episodes. Other therapies include direct thrombin inhibitors, inhibitors of platelet function, such as aspirin and dextran, and therapies to counteract venous stasis, including compression stockings and pneumatic compression devices. Selected uPA polypeptides provided herein that inhibit blood coagulation can be used in anticoagulant therapies for thromboembolic disease and/or DVT. In some embodiments, selected uPA polypeptides provided herein that inhibit blood coagulation can be used in prevention therapies thromboembolic disease and/or DVT in patients exhibiting risk factors for thromboembolic disease and/or DVT.

(a) Ischemic Stroke

Ischemic stroke occurs when the blood flow to the brain is interrupted, wherein the sudden loss of circulation to an area of the brain results in a corresponding loss of neurologic function. In contrast to a hemorrhagic stroke, which is characterized by intracerebral bleeding, an ischemic stroke is usually caused by thrombosis or embolism. Ischemic strokes account for approximately 80% of all strokes. In addition to the causes and risk factors for development a thromboembolism as discussed above, processes that cause dissection of the cerebral arteries (e.g., trauma, thoracic aortic dissection, arteritis) can cause thrombotic stroke. Other causes include hypoperfusion distal to a stenotic or occluded artery or hypoperfusion of a vulnerable watershed region between 2 cerebral arterial territories. Treatments for ischemic stroke involve anticoagulant therapy for the prevention and treatment of the condition. Selected uPA polypeptides provided herein that inhibit coagulation can be used in the treatment and/or prevention or reduction of risk of ischemic stroke.

iii. Acquired Coagulation Disorders

Acquired coagulation disorders are the result of conditions or diseases, such as vitamin K deficiency, liver disease, disseminated intravascular coagulation (DIC), or development of circulation anticoagulants. The defects in blood coagulation are the result of secondary deficiencies in clotting factors caused by the condition or disease. For example, production of coagulation factors from the liver is often impaired when the liver is in a diseased state. Along with decreased synthesis of coagulation factors, fibrinolysis becomes increased and thrombocytopenia (deficiency in platelets) is increased. Decreased production of coagulation factors by the liver also can result from fulminant hepatitis or acute fatty liver of pregnancy. Such conditions promote intravascular clotting which consumes available coagulation factors. Selected uPA polypeptides provided herein can be used in the treatment of acquired coagulation disorders in order to alleviate deficiencies in blood clotting factors.

(a) Disseminated Intravascular Coagulation (DIC)

Disseminated intravascular coagulation (DIC) is a disorder characterized by a widespread and ongoing activation of coagulation. In DIC, there is a loss of balance between thrombin activation of coagulation and plasmin degradation of blot clots. Vascular or microvascular fibrin deposition as a result can compromise the blood supply to various organs, which can contribute to organ failure. In sub-acute or chronic DIC, patients present with a hypercoagulatory phenotype, with thromboses from excess thrombin formation, and the symptoms and signs of venous thrombosis can be present. In contrast to acute DIC, sub-acute or chronic DIC is treated by methods of alleviating the hyperthrombosis, including heparin, anti-thrombin III and activated protein C treatment. The selected uPA polypeptides provided herein and the nucleic acids encoding the selected uPA polypeptides provided herein can be used in therapies for sub-acute or chronic DIC. In one embodiment, the sub-acute or chronic DIC polypeptides herein, and nucleic acids encoding the selected uPA polypeptides can be used in combination with other anticoagulation therapies. Selected uPA polypeptides can be tested for therapeutic effectiveness, for example, by using animal models. Progression of disease symptoms and phenotypes is monitored to assess the effects of the selected uPA polypeptides. Selected uPA polypeptides also can be administered to animal models as well as subjects such as in clinical trials to assess in vivo effectiveness in comparison to placebo controls.

(b) Bacterial Infection and Periodontitis

Systemic infection with microorganisms, such as bacteria, is commonly associated with DIC. The upregulation of coagulation pathways can be mediated in part by cell membrane components of the microorganism (lipopolysaccharide or endotoxin) or bacterial exotoxins (e.g. staphylococcal alpha toxin) that cause inflammatory responses leading to elevated levels of cytokines. The cytokines, in turn, can influence induction of coagulation.

Bacterial pathogens, such as *Porphyrus gingivalis*, are well-known as causative agents for adult periodontitis. The *Porphyrus gingivalis* bacterium produces arginine-specific cysteine proteinases that function as virulence factors (Grenier et al. *J. Clin. Microbiol.* 25:738-740 (1987), Smalley et al. *Oral Microbiol. Immunol.* 4:178-181 (1989), Marsh, et al. *FEMS Microbiol.* 59:181-185 (1989), and Potempa et al. *J. Biol. Chem.* 273:21648-21657 (1998). *Porphyrus gingivalis* generated two proteinases that are referred to as 50 kDa and 95 kDa gingipains R (RgpB and HRgpA, respectively). The protease can proteolytically cleave and hence activate coagulation factors. During bacterial infection release of the gingipains R into the blood stream can thus lead to uncontrolled activation of the coagulation cascade leading to overproduction of thrombin and increase the possibility of inducing disseminated intravascular coagulation (DIC). The large increases in thrombin concentrations can furthermore contribute alveolar bone resorption by osteoclasts at sites of periodontitis.

The selected uPA polypeptides provided herein that inhibit blood coagulation, and nucleic acids encoding selected uPA polypeptides can be used in treatment of periodontitis. Selected uPA polypeptides can be tested for therapeutic effectiveness for airway responsiveness in periodontitis models. Such models are available in animals, such as nonhuman primates, dogs, mice, rats, hamsters, and guinea pigs (Weinberg and Bral, *J. of Periodontology* 26(6), 335-340). Selected uPA polypeptides also can be administered to animal models as well as subjects such as in clinical trials to assess in vivo effectiveness in comparison to placebo controls.

b. Other tPA Target-Associated Conditions

The selected uPA polypeptides provided herein also can be used in treatment of neurological conditions for which tPA had been implicated. tPA is thought to regulate physiological processes that include tissue remodeling and plasticity due to the ability of tPA to hydrolyze extracellular matrix proteins and other substrates (Gravanis and Tsirska (2004) *Glia* 49:177-183). Patients who have experienced events such as stroke or injury (e.g., due to accident or surgery) often suffer from neurological damage that can be treatable with selected uPA polypeptides provided herein. The selected uPA polypeptides provided herein can be useful for treating subjects suffering from a variety of neurological diseases and conditions including, but not limited to, neurodegenerative diseases such as multiple sclerosis, amyotrophic lateral sclerosis, subacute sclerosing panencephalitis, Parkinson's disease, Huntington's disease, muscular dystrophy, and conditions caused by nutrient deprivation or toxins (e.g., neurotoxins, drugs of abuse). Additionally, selected uPA polypeptides can be useful for providing cognitive enhancement and/or for treating cognitive decline, e.g., "benign senescent forgetfulness", "age-associated memory impairment", "age-associated cognitive decline", etc. (Petersen et al., *J Immunological Meth.* 257:107-116 (2001)), and Alzheimer's disease.

Selected uPA polypeptides can be tested using any of a variety of animal models for injury to the nervous system. Models that can be used include, but are not limited to, rodent, rabbit, cat, dog, or primate models for thromboembolic stroke (Krueger and Busch, *Invest. Radiol.* 37:600-8 (2002); Gupta and Briyal, *Indian J. Physiol. Pharmacol.* 48:379-94 (2004)), models for spinal cord injury (Webb et al., *Vet. Rec.* 155:225-30 (2004)), etc. The methods and compositions also can be tested in humans. A variety of different methods, including standardized tests and scoring systems, are available for assessing recovery of motor, sensory, behavioral, and/or cognitive function in animals and humans. Any suitable method can be used. In one example, the American Spinal Injury Association score, which has become the principal instrument for measuring the recovery of sensory function in humans, could be used. See, e.g., Martinez-Arizala, *J Rehabil. Res. Dev.* 40:35-9 (2003), Thomas and Noga, *J Rehabil. Res. Dev.* 40:25-33 (2003), Kesslak and Keirstead, *J Spinal Cord Med.* 26:323-8 (2003) for examples of various scoring systems and methods. Preferred dose ranges for use in humans can be established by testing the agent(s) in tissue culture systems and in animal models taking into account the efficacy of the agent(s) and also any observed toxicity.

c. Diagnostic Methods

Selected uPA polypeptides provided herein can be used in diagnostic methods including, but not limited to, diagnostic assays to detect fibrin and fibrin degradation products that have altered activities. The assays are thus indicated in thrombotic conditions. Other diagnostic applications, include kits containing antibodies against the selected uPA polypeptides and are familiar to one of ordinary skill in the art.

2. Exemplary Methods of Treatment for Selected Protease Polypeptides that Cleave VEGF or VEGFR Targets Vascular endothelial growth factor (VEGF) is a cytokine that binds and signals through a specific cell surface receptor (VEGFR) to regulate angiogenesis, the process in which new blood vessels are generated from existing vasculature. Pathological angiogenesis describes the increased vascularization associated with disease and includes events such as the growth of solid tumors (McMahon, (2000) *Oncologist.* 5 Suppl 1:3-10), macular degeneration and diabetes. In cancer, solid tumors require an ever-increasing blood supply for growth and metastasis. Hypoxia or oncogenic mutation increases the levels of VEGF and VEGF-R mRNA in the tumor and surrounding stromal cells leading to the extension of existing vessels and formation of a new vascular network. In wet macular degeneration, abnormal blood vessel growth forms beneath the macula. These vessels leak blood and fluid into the macula damaging photoreceptor cells. In diabetes, a lack of blood to the eyes also can lead to blindness. VEGF stimulation of capillary growth around the eye leads to disordered vessels which do not function properly.

Three tyrosine kinase family receptors of VEGF have been identified (VEGFR-1/Flt-1, VEGF-R-2/Flk-1/KDR, VEGF-R-3/Flt-4). KDR (the mouse homolog is Flk-1) is a high affinity receptor of VEGF with a Kd of 400-800 µM (Waltenberger, (1994) *J Biol. Chem.* 269(43):26988-95) expressed exclusively on endothelial cells. VEGF and KDR association has been identified as a key endothelial cell-specific signaling pathway required for pathological angiogenesis (Kim, (1993) *Nature.* 362 (6423):841-4; Millauer, (1994) *Nature.* 367 (6463):576-9; Yoshiji, (1999) *Hepatology.* 30(5): 1179-86). Dimerization of the receptor upon ligand binding causes autophosphorylation of the cytoplasmic domains, and recruitment of binding partners that propagate signaling throughout the cytoplasm and into the nucleus to change the cell growth programs. Treatment of tumors with a soluble VEGF-R2 inhibits tumor growth (Lin, (1998) *Cell Growth Differ.* 9(1):49-58), and chemical inhibition of phosphorylation causes tumor cells to become apoptotic (Shaheen, (1999) *Cancer Res.* 59(21):5412-6).

Signaling by vascular endothelial growth factor (VEGF) and its receptors is implicated in pathological angiogenesis and the rapid development of tumor vasculature in cancer. Drugs that block this signaling pathway prevent the growth and maintenance of tumor blood supply, and lead to the systematic death of the tumor. The recent success of the anti-VEGF antibody AVASTIN™ in patients with metastatic colon cancer has validated VEGF as a target for anti-angiogenic therapy of cancer. Despite these encouraging results, tumor progression has still occurred despite anti-VEGF treatment. The mechanisms of antibody affecting VEGF function and how the antibody impedes tumor growth are unknown. Knock down experiments show that blocking VEGF function blocks angiogenesis. Thus the inhibition of angiogenic signaling through VEGFR-2 represents an underdeveloped therapeutic area ideal for the development of engineered proteases with novel targeting.

Therapies targeting the VEGF receptors and Flk-1/KDR specifically have inhibited pathological angiogenesis and shown reduction of tumor size in multiple mouse models of human and mouse solid tumors (Prewett, (1999) *Cancer Res.* 59(20):5209-18; Fong, (1999) *Neoplasia* 1(1):31-41. Erratum in: (1999) *Neoplasia* 1(2):183) alone and in combination with cytotoxic therapies (Klement, (2000) *J Clin Invest.* 105 (8):R15-24). Studies with small molecule inhibitors and antibodies validate the VEGF receptor family as a potent antiangiogenesis target but more effective therapeutics are still needed.

VEGFR is composed of an extracellular region of seven immunoglobin (Ig)-like domains, a transmembrane region, and two cytoplasmic tyrosine kinase domains. The first three Ig-like domains have been shown to regulate ligand binding, while domains 4 through 7 have a role in inhibiting correct dimerization and signaling in the absence of ligand. As a target for selective proteolysis by engineered proteases, it has the following promising target characteristics: a labile region of amino acids accessible to proteolysis; high sequence identity between the human, rat and mouse species; down regulation of signaling upon cleavage; and proteolytic generation of soluble receptors able to non-productively bind ligand. Several regions of VEGF-R2 are available for specific proteolysis including the stalk region before the transmembrane region and unstructured loop between Ig-like domains. In one example, serine-like proteases provided herein can be engineered to cleave specific target receptors between their transmembrane and cytokine or growth factor binding domains (e.g. VEGFR). The stalk regions that function to tether protein receptors to the surface of a cell or loop regions are thereby disconnected from the globular domains in a polypeptide chain.

a. Angiogenesis, Cancer, and Other Cell Cycle Dependent Diseases or Conditions

Exemplary selected proteases provided herein cleave a VEGF or VEGFR which are responsible for modulation of angiogenesis. Where the cell surface molecule is a VEGFR signaling in tumor angiogenesis, cleavage prevents the spread of cancer. For example, cleavage of a cell surface domain from a VEGFR molecule can inactivate its ability to transmit extracellular signals, especially cell proliferation signals. Without angiogenesis to feed the tumor, cancer cells often cannot proliferate. In one embodiment, a selected protease provided herein is therefore used to treat cancer. Also, cleavage of VEGFR can be used to modulate angiogenesis in other pathologies, such as macular degeneration, inflammation and diabetes. In one embodiment, cleaving a target VEGF or VEGFR protein involved in cell cycle progression inactivates the ability of the protein to allow the cell cycle to go forward. Without the progression of the cell cycle, cancer cells can not proliferate. Therefore, the selected proteases provided herein which cleave VEGF or VEGFR are used to treat cancer and other cell cycle dependent pathologies.

Selected proteases provided herein also can cleave soluble proteins that are responsible for tumorigenicity. Cleaving VEGF polypeptide prevents signaling through the VEGF receptor and decreases angiogenesis, thus decreasing disease in which angiogenesis plays a role, such as cancer, macular degeneration, inflammation and diabetes. Further, VEGF signaling is responsible for the modulation of the cell cycle in certain cell types. Therefore, the selected proteases provided herein which cleave VEGF are useful in the treatment of cancer and other cell cycle dependent pathologies.

b. Combination Therapies with Selected Proteases that Cleave VEGF or VEGFR

In one embodiment, treatment of a pathology, such as a cancer, involves administration to a subject in need thereof therapeutically effective amounts of a protease that specifically cleaves and inactivates the signaling of the VEGF/VEGFR-2 complex, such as in combination with at least one anti-cancer agent. Antiangiogenic therapy has proven successful against both solid cancers and hematological malignancies. (See, e.g., Ribatti et al. (2003) *J Hematother Stem Cell Res.* 12(1), 11-22). Therefore, compositions provided herein as antiangiogenic therapy can facilitate the treatment of both hematological and sold tissue malignancies. Compositions and methods of treatment provided herein can be administered alone or in combination with any other appropriate anti-cancer treatment known to one skilled in the art. For example, the selected proteases provided herein can be administered in combination with or in place of AVASTIN™ in any therapy where AVASTIN™ administration provides therapeutic benefit.

In one embodiment, the anti-cancer agent is at least one chemotherapeutic agent. In a related embodiment, the administering of the protease is in combination with at least one radiotherapy. Administration of the combination therapy will attenuate the angiogenic signal and create a pool of soluble receptor that lowers free VEGF levels. In a specific embodiment, a selected protease provided herein has an in vitro specificity that matches a critical region of the receptor, the Flk-1/KDR stalk, over a six amino acid region.

The selected protease polypeptides provided herein can be administered in a composition containing more than one therapeutic agent. The therapeutic agents can be the same or different, and can be, for example, therapeutic radionuclides, drugs, hormones, hormone antagonists, receptor antagonists, enzymes or proenzymes activated by another agent, autocrines, cytokines or any suitable anti-cancer agent known to those skilled in the art. In one embodiment, the anti-cancer agent co-administered with the selected protease polypeptide is AVASTIN™. Other therapeutic agents useful in the methods provided herein include toxins, anti-DNA, anti-RNA, radiolabeled oligonucleotides, such as antisense oligonucleotides, anti-protein and anti-chromatin cytotoxic or antimicrobial agents. Other therapeutic agents are known to those skilled in the art, and the use of such other therapeutic agents in accordance with the method provided herein is specifically contemplated.

The antitumor agent can be one of numerous chemotherapy agents such as an alkylating agent, an antimetabolite, a hormonal agent, an antibiotic, an antibody, an anti-cancer biological, Gleevec, colchicine, a vinca alkaloid, L-asparaginase, procarbazine, hydroxyurea, mitotane, nitrosoureas or an imidazole carboxamide. Suitable agents are those agents that promote depolarization of tubulin or prohibit tumor cell proliferation. Chemotherapeutic agents contemplated include, but are not limited to, anti-cancer agents listed in the Orange Book of Approved Drug Products With Therapeutic Equivalence Evaluations, as compiled by the Food and Drug Administration and the U.S. Department of Health and Human Services. In addition to the above chemotherapy agents, the serine protease-like proteases provided herein also can be administered together with radiation therapy treatment. Additional treatments known in the art are contemplated.

The therapeutic agent can be a chemotherapeutic agent. Chemotherapeutic agents are known in the art and include at least the taxanes, nitrogen mustards, ethylenimine derivatives, alkyl sulfonates, nitrosoureas, triazenes, folic acid analogs, pyrimidine analogs, purine analogs, vinca alkaloids, antibiotics, enzymes, platinum coordination complexes, substituted urea, methyl hydrazine derivatives, adrenocortical suppressants, or antagonists. More specifically, the chemotherapeutic agents can be one or more agents chosen from the non-limiting group of steroids, progestins, estrogens, antiestrogens, or androgens. Even more specifically, the chemotherapy agents can be azaribine, bleomycin, bryostatin-1, busulfan, carmustine, chlorambucil, cisplatin, CPT-11, cyclophosphamide, cytarabine, dacarbazine, dactinomycin, daunorubicin, dexamethasone, diethylstilbestrol, doxorubicin, ethinyl estradiol, etoposide, fluorouracil, fluoxymesterone, gemcitabine, hydroxyprogesterone caproate, hydroxyurea, L-asparaginase, leucovorin, lomustine, mechlorethamine, medroprogesterone acetate, megestrol acetate, melphalan, mercaptopurine, methotrexate, methotrexate, mithramycin, mitomycin, mitotane, phenyl butyrate, prednisone, procarbazine, semustine streptozocin, tamoxifen, taxanes, taxol, testosterone propionate, thalidomide, thioguanine, thiotepa, uracil mustard, vinblastine, or vincristine. The use of any combinations of chemotherapy agents also is contemplated. The administration of the chemotherapeutic agent can be before, during or after the administration of the serine protease-like mutein polypeptide.

Other suitable therapeutic agents for use in combination or for co-administration with the selected protease polypeptides provided herein are selected from the group consisting of radioisotope, boron addend, immunomodulator, toxin, photoactive agent or dye, cancer chemotherapeutic drug, antiviral drug, antifungal drug, antibacterial drug, antiprotozoal drug and chemosensitizing agent (See, U.S. Pat. Nos. 4,925,648 and 4,932,412). Suitable chemotherapeutic agents are described, for example, in REMINGTON'S PHARMACEUTICAL SCIENCES, 19th Ed. (Mack Publishing Co. 1995), and in Goodman and Gilman's THE PHARMACOLOGICAL BASIS OF THERAPEUTICS (Goodman et al., Eds. Macmillan Publishing Co., New York, 1980 and 2001 editions). Other suitable chemotherapeutic agents, such as experimental drugs, are known to those of skill in the art. Moreover a suitable therapeutic radioisotope is selected from the group consisting of ax-emitters, β-emitters, γ-emitters, Auger electron emitters, neutron capturing agents that emit α-particles and radioisotopes that decay by electron capture. Preferably, the radioisotope is selected from the group consisting of $^{225}$Ac, $^{198}$Au, $^{32}$P, $^{131}$I, $^{131}$I, $^{90}$Y, $^{186}$Re, $^{188}$Re, $^{67}$Cu, $^{177}$Lu, $^{213}$Bi, $^{10}$B, and $^{211}$At.

Where more than one therapeutic agent is used in combination with the selected proteases provided herein, they can be of the same class or type or can be from different classes or types. For example, the therapeutic agents can comprise different radionuclides, or a drug and a radionuclide.

In another embodiment, different isotopes that are effective over different distances as a result of their individual energy emissions are used as first and second therapeutic agents in combination with the proteases provided herein. Such agents can be used to achieve more effective treatment of tumors, and are useful in patients presenting with multiple tumors of differing sizes, as in normal clinical circumstances.

Few of the available isotopes are useful for treating the very smallest tumor deposits and single cells. In these situations, a drug or toxin can be a more useful therapeutic agent for co-administration with a protease provided herein. Accordingly, in some embodiments, isotopes are used in combination with non-isotopic species such as drugs, toxins, and neutron capture agents and co-administered with a protease provided herein. Many drugs and toxins are known which have cytotoxic effects on cells, and can be used in combination with the proteases provided herein. They are to be found in compendia of drugs and toxins, such as the Merck Index, Goodman and Gilman, and the like, and in the references cited above.

Drugs that interfere with intracellular protein synthesis also can be used in combination with a protease in the therapeutic the methods herein; such drugs are known to those skilled in the art and include puromycin, cycloheximide, and ribonuclease.

The therapeutic methods provided herein can be used for cancer therapy. It is well known that radioisotopes, drugs, and toxins can be conjugated to antibodies or antibody fragments which specifically bind to markers which are produced by or associated with cancer cells, and that such antibody conjugates can be used to target the radioisotopes, drugs or toxins to tumor sites to enhance their therapeutic efficacy and minimize side effects. Examples of these agents and methods are reviewed in Wawrzynczak and Thorpe (in Introduction to the Cellular and Molecular Biology of Cancer, L. M. Franks and N. M. Teich, eds, Chapter 18, pp. 378-410, Oxford University Press. Oxford, 1986), in Immunoconjugates: Antibody Conjugates in Radioimaging and Therapy of Cancer (C. W. Vogel, ed., 3-300, Oxford University Press, N.Y., 1987), in Dillman, R. O. (CRC Critical Reviews in Oncology/Hematology 1:357, CRC Press, Inc., 1984), in Pastan et al. (Cell 47:641, 1986) in Vitetta et al. (Science 238:1098-1104, 1987) and in Brady et al. (Int. J. Rad. Oncol. Biol. Phys. 13:1535-1544, 1987). Other examples of the use of immunoconjugates for cancer and other forms of therapy have been disclosed, inter alia, in U.S. Pat. Nos. 4,331,647, 4,348,376, 4,361,544, 4,468,457, 4,444,744, 4,460,459, 4,460,561 4,624,846, 4,818,709, 4,046,722, 4,671,958, 4,046,784, 5,332,567, 5,443,953, 5,541,297, 5,601,825, 5,635,603, 5,637,288, 5,677,427, 5,686,578, 5,698,178, 5,789,554, 5,922,302, 6,187,287, and 6,319,500.

Additionally, the treatment methods provided herein include those in which a selected protease herein is used in combination with other compounds or techniques for preventing, mitigating or reversing the side effects of certain cytotoxic agents. Examples of such combinations include, e.g., administration of IL-1 together with an antibody for rapid clearance, as described in e.g., U.S. Pat. No. 4,624,846. Such administration can be performed from 3 to 72 hours after administration of a primary therapeutic treatment with a granzyme B mutein or MT-SP1 mutein in combination with an anti-cancer agent (e.g., with a radioisotope, drug or toxin as the cytotoxic component). This can be used to enhance clearance of the conjugate, drug or toxin from the circulation and to mitigate or reverse myeloid and other hematopoietic toxicity caused by the therapeutic agent.

In another example, and as noted above, cancer therapy can involve a combination of more than one tumoricidal agent, e.g., a drug and a radioisotope, or a radioisotope and a Boron-10 agent for neutron-activated therapy, or a drug and a biological response modifier, or a fusion molecule conjugate and a biological response modifier. The cytokine can be integrated into such a therapeutic regimen to maximize the efficacy of each component thereof.

Similarly, certain antileukemic and antilymphoma antibodies conjugated with radioisotopes that are β or α-emitters can induce myeloid and other hematopoietic side effects when these agents are not solely directed to the tumor cells. This is observed particularly when the tumor cells are in the circulation and in the blood-forming organs. Concomitant and/or subsequent administration of at least one hematopoietic cytokine (e.g., growth factors, such as colony stimulating factors, such as G-CSF and GM-CSF) is preferred to reduce or ameliorate the hematopoietic side effects, while augmenting the anticancer effects.

It is well known in the art that various methods of radionuclide therapy can be used for the treatment of cancer and other pathological conditions, as described, e.g., in Harbert, "Nuclear Medicine Therapy", New York, Thieme Medical Publishers, 1087, pp. 1-340. A clinician experienced in these procedures will readily be able to adapt the cytokine adjuvant therapy described herein to such procedures to mitigate any hematopoietic side effects thereof. Similarly, therapy with cytotoxic drugs, co-administered with a protease mutein, can be used, e.g., for treatment of cancer, infectious or autoimmune diseases, and for organ rejection therapy. Such treatment is governed by analogous principles to radioisotope therapy with isotopes or radiolabeled antibodies. Thus, the ordinary skilled clinician will be able to adapt the description of cytokine use to mitigate marrow suppression and other such hematopoietic side effects by administration of the cytokine before, during and/or after the primary anti-cancer therapy.

3. Exemplary Methods of Treatment for Selected MT-SP1 Polypeptides that Cleave Complement Protein Targets The protease polypeptides and nucleic acid molecules provided herein can be used for treatment of any condition for which activation of the complement pathway is implicated, particularly inflammatory conditions including acute inflammatory conditions, such as septic shock, and chronic inflammatory conditions, such as Rheumatoid Arthritis (RA). Acute and inflammatory conditions can be manifested as an immune-mediated disease such as for example autoimmune disease or tissue injury caused by immune-complex-mediated inflammation. A complement-mediated inflammatory condition also can be manifested as a neurodegenerative or cardiovascular disease that have inflammatory components. This section provides exemplary uses of, and administration methods for, proteases. These described therapies are exemplary and do not limit the applications of proteases. Such methods include, but are not limited to, methods of treatment of physiological and medical conditions described and listed below. Such methods include, but are not limited to, methods of treatment of sepsis, Rheumatoid arthritis (RA), membranoproliferative glomerulonephritis (MPGN), lupus erythematosus, Multiple Sclerosis (MS), Myasthenia gravis (MG), asthma, inflammatory bowel disease, respiratory distress syndrome, immune complex (IC)-mediated acute inflammatory tissue injury, multi-organ failure, Alzheimer's Disease (AD), Ischemia-reperfusion injuries caused by events or treatments such as myocardial infarct (MI), stroke, cardiopulmonary bypass (CPB) or coronary artery bypass graft, angioplasty, or hemodialysis, or Guillan Barre syndrome.

Treatment of diseases and conditions with proteases can be effected by any suitable route of administration using suitable formulations as described herein including, but not limited to, subcutaneous injection, oral and transdermal administration. If necessary, a particular dosage and duration and treatment protocol can be empirically determined or extrapolated. For example, exemplary doses of recombinant and native protease polypeptides can be used as a starting point to determine appropriate dosages. Modified proteases that have more specificity and/or selectivity compared to a wildtype or scaffold protease can be effective at reduced dosage amounts and or frequencies. Dosage levels can be determined based on a variety of factors, such as body weight of the individual, general health, age, the activity of the specific compound employed, sex, diet, time of administration, rate of excretion, drug combination, the severity and course of the disease, and the patient's disposition to the disease and the judgment of the treating physician. The amount of active ingredient that can be combined with the carrier materials to produce a single dosage form with vary depending upon the host treated and the particular mode of administration.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms.

a. Immune-Mediated Inflammatory Diseases

Proteases and modified proteases selected in the method described herein, including but not limited to variant MT-SP 1 proteases provided herein, can be used to treat inflammatory diseases. Inflammatory diseases that can be treated with proteases include acute and chronic inflammatory diseases. Exemplary inflammatory diseases include central nervous system diseases (CNS), autoimmune diseases, airway hyperresponsiveness conditions such as in asthma, rheumatoid arthritis, inflammatory bowel disease, and immune complex (IC)-mediated acute inflammatory tissue injury.

Experimental autoimmune encephalomyelitis (EAE) can serve as a model for multiple sclerosis (MS) (Piddlesden et al., (1994) *J Immunol* 152:5477). EAE can be induced in a number of genetically susceptible species by immunization with myelin and myelin components such as myelin basic protein, proteolipid protein and myelin oligodendrocyte glycoprotein (MOG). For example, MOG-induced EAE recapitulates essential features of human MS including the chronic, relapsing clinical disease course the pathohistological triad of inflammation, reactive gliosis, and the formation of large confluent demyelinated plaques. Proteases and modified proteases can be assessed in EAE animal models. Proteases are administered, such as by daily intraperitoneal injection, and the course and progression of symptoms is monitored compared to control animals. The levels of inflammatory complement components that can exacerbate the disease also can be measured by assaying serum complement activity in a hemolytic assay and by assaying for the deposition of complement components, such as for example C1, C3 and C9.

Complement activation modulates inflammation in diseases such as rheumatoid arthritis (RA) (Wang et al., (1995) *PNAS* 92:8955). Proteases and modified proteases, including variant MT-SP1 polypeptides provided herein, can be used to treat RA. For example, proteases can be injected locally or systemically. Proteases can be dosed daily or weekly. PEGylated proteases can be used to reduce immunogenicity. In one example, type II collagen-induced arthritis (CIA) can be induced in mice as a model of autoimmune inflammatory joint disease that is histologically similar to RA characterized by inflammatory synovitis, pannus formation, and erosion of cartilage and bone. To induce CIA, bovine type II collagen (B-CII) in the presence of complete Freund's adjuvant can be injected intradermally at the base of the tail. After 21 days, mice can be reimmunized using the identical protocol. To examine the effects of a protease or modified protease, including MT-SP1 polypeptides, 3 weeks following the initial challenge with B-CII, a protease or control can be administered intraperitoneally twice weekly for 3 weeks. Mice can be sacrificed 7 weeks following the initial immunization for histologic analysis. To assess the therapeutic affect of a protease on established disease, a protease can be administered daily for a total of 10 days following the onset of clinical arthritis in one or more limbs. The degree of swelling in the initially affected joints can be monitored by measuring paw thickness using calipers. In both models, serum can be drawn from mice for hemolytic assays and measurement of complement markers of activation such as for example C5a and C5b-9. In another example, primate models are available for RA treatments. Response of tender and swollen joints can be monitored in subjects treated with protease polypeptides and controls to assess protease treatment.

Proteases or modified proteases, including but not limited to variant MT-SP1 polypeptides provided herein, can be used to treat immune complex (IC)-mediated acute inflammatory tissue injury. IC-mediated injury is caused by a local inflammatory response against IC deposition in a tissue. The ensuing inflammatory response is characterized by edema, neutrophila, hemorrhage, and finally tissue necrosis. IC-mediated tissue injury can be studied in an in vivo Arthus (RPA) reaction. Briefly, in the RPA reaction, an excess of antibody (such as for example rabbit IgG anti-chicken egg albumin) is injected into the skin of animals, such as for example rats or guinea pigs, that have previously been infused intravenously with the corresponding antigen (i.e. chicken egg albumin) (Szalai et al., (2000) *J Immunol* 164:463). Immediately before the initiation on an RPA reaction, a protease, or a bolus control, can be administered at the same time as the corresponding antigen by an intravenous injection via the right femoral vein. Alternatively, a protease can be administered during the initial hour of the RPA reaction, beginning immediately after injection of the antigen and just before dermal injection of the antibody. The effects of a protease on the generation of complement-dependent IC-mediated tissue injury can be assessed at various times after initiation of RPA by collecting blood to determine the serum hemolytic activity, and by harvesting the infected area of the skin for quantitation of lesion size.

Therapeutic proteases, such as those described herein including variant MT-SP1 polypeptides provided herein, can be used to treat sepsis and severe sepsis that can result in lethal shock. A model of complement-mediated lethal shock can be used to test the effects of a protease as a therapeutic agent. In one such example, rats can be primed with a trace amount of lipopolysaccharide (LPS), followed by the administration of a monoclonal antibody against a membrane inhibitor of complement (anti-Crry) (Mizuno M et al., (2002) *Int Arch Allergy Immunol* 127:55). A protease or control can be administered at any time during the course of initiation of lethal shock such as before LPS priming, after LPS priming, or after anti-Crry administration and the rescue of rats from lethal shock can be assessed.

b. Neurodegenerative Disease

Complement activation exacerbates the progression of Alzheimer's disease (AD) and contributes to neurite loss in AD brains. Proteases and modified proteases described herein, including but not limited to variant MT-SP1 polypeptides provided herein, can be used to treat AD. Mouse models that mimic some of the neuropathological and behavioral features of AD can be used to assess the therapeutic effects of proteases. Examples of transgenic mouse models include introducing the human amyloid precursor protein (APP) or the presenilin 1 (PS1) protein with disease-producing mutations into mice under the control of an aggressive promoter. These mice develop characteristics of AD including increases in beta-amyloid plaques and dystrophic neurites. Double transgenic mice for APP and PSI mutant proteins develop larger numbers of fibrillar beta-amyloid plaques and show activated glia and complement factors associated with the plaque. Proteases can be administered, such as by daily intraperitoneal or intravenous injections, and the course and progression of symptoms is monitored compared to control animals.

c. Cardiovascular Disease

Proteases and modified proteases described herein, including but not limited to variant MT-SP1 proteases provided herein, can be used to treat cardiovascular disease. Proteases can be used in the treatment of cardiovascular diseases including ischemia reperfusion injury resulting from stroke, myocardial infarction, cardiopulmonary bypass, coronary artery bypass graft, angioplasty, or hemodialysis. Proteases also can be used in the treatment of the inflammatory response associated with cardiopulmonary bypass that can contribute to tissue injury. Generally, a protease can be administered prior to, concomitantly with, or subsequent to a treatment or event that induces a complement-mediated ischemia reperfusion injury. In one example, a protease can be administered to a subject prior to the treatment of a subject by a complement-mediated, ischemic-injury inducing event, such as for example coronary artery bypass graft of angioplasty.

Effects of a protease on treatment of ischemia reperfusion injury can be assessed in animal models of the injury. In one such model, myocardial ischemia is induced in rabbits that have had an incision made in their anterior pericardium by placing a 3-0 silk suture around the left anterior descending (LAD) coronary artery 5-8 mm from its origin and tightening the ligature so that the vessel becomes completely occluded (Buerke et al., (2001) *J Immunol* 167:5375). A protease, such as for example a variant MT-SP1 polypeptide provided herein, or a control vehicle such as saline, can be given intravenously in increasing doses as a bolus 55 minutes after the coronary occlusion (i.e. 5 minutes before reperfusion). Five minutes later (i.e. after a total of 60 minutes of ischemia) the LAD ligature can be untied and the ischemic myocardium can be reperfused for 3 hours. At the end of the reperfusion period, the ligature around the LAD is tightened. Effects of a protease on ischemia injury can be analyzed by assessing effects on myocardial necrosis, plasma creatine kinase levels, and markers of neutrophil activation such as for example myeloperoxidase activity and superoxide radical release.

In another model of complement-mediated myocardial injury sustained upon perfusion of isolated mouse hearts with Krebs-Henseleit buffer containing 6% human plasma, treatment with proteases or modified proteases can be used to limit tissue damage to the heart. In such an example, the buffer used to perfuse the hearts can be supplemented with varying doses of proteases, such as but not limited to variant proteases including MT-SP1 polypeptides polypeptides provided herein. The perfused hearts can be assayed for deposition of human C3 and C5b-9, coronary artery perfusion pressure, end-diastolic pressure, and heart rate.

Proteases and modified proteases, such as for example variant MT-S P1 polypeptides provided herein, can be used as therapeutics prior to or following Cardiopulmonary Bypass (CPB) or coronary artery bypass graft to inhibit the inflammatory immune response that often follows bypass and that can contribute to tissue injury. An in vitro recirculation of whole blood in an extracorporeal bypass circuit can be used to stimulate platelet and leukocyte changes and complement activation induced by CPB (Rinder et al. (1995) *J. Clin. Invest.* 96:1564). In such a model, addition of a protease or modified protease or control buffer, in varying doses, can be added to a transfer pack already containing blood from a healthy donor and porcine heparin, just prior to addition of the blood to the extracorporeal circuit. Blood samples can be drawn at 5, 15, 30, 45, 60, 75, and 90 minutes after recirculation and assayed for complement studies such as for example hemolytic assays and/or complement activation assays to measure for C5a, C3a, and/or sC5b-9. A pretreatment sample of blood drawn before its addition to the extracorporeal circuit can be used as a control. Flow cytometry of blood samples can be performed to determine levels of adhesion molecules on populations of circulating leukocytes (i.e. neutrophils) in the blood such as for example CD11b and P-selectin levels.

K. EXAMPLES

The following examples are included for illustrative purposes only and are not intended to limit the scope of the invention.

Example 1

Mutant PAI-1 Inhibitors

A. Expression and Purification of Mutant PAI-1 Inhibitors

The pPAIST7HS, recombinant plasmid carrying the cDNA of human PAI-1 (encoding mature PAI-1 containing an N-terminal Met as set forth in SEQ ID NO:396), was used as template to introduce modifications into the amino acid sequence of the PAI-1 reactive center loop. Plasmid pPAISTHS is a derivative of plasmid pPAIST7 lacking the HindIII site at nucleotide pair 1 and the SalI site at nucleotide pair 2106. Plasmid pPAIST7 was generated as described (Franke et al. (1990) *Biochimic et Biophysica Acta* 1037: 16-23). Briefly, the PAI-1 cDNA clone pPAI-11RB was cleaved with restriction endonucleases ApaLI and PflMI, and the 1127 bp fragment of PAI-1 containing 2 bp of the codon for residue I of PAI-1 and the full coding sequence for residues 2-376 of the 379-residue protein was purified by gel electrophoresis. Synthetic linkers were constructed to reconstruct both ends of the PAI-1 cDNA coding sequence and to introduce an ATG protein synthesis initiation codon immediately before the triplet encoding the first residue of mature PAI-1 generating a mature PAI-1 having a sequence of amino acids set forth in SEQ ID NO:396. In addition, to facilitate insertion of the cDNA coding region into plasmid pBR322, the linkers were designed to generate EcoRI and HindIII restriction endonuclease sites at the 5' and 3' termini, respectively, of the PAI-1 cDNA fragment. The synthetic linkers are as follows: N-terminus, 5'AATTCTATGG-3' (SEQ ID NO:392) and 5'-TGCACCATAG-3' (SEQ ID NO:393); C-terminus, 5'-ATGGAACCCTGAA-3' (SEQ ID NO:394) and 5'-AGCTTCAGGGTTCCATCAC-3' (SEQ ID NO:395). The linkers were treated with polynucleotide kinase before use. The synthetic linkers (10 bp at the 5' end and 13 bp at the 3' end) were then ligated with the 1127 bp ApaLI-PflMI DNA fragment, digested with EcoRI and HindIII and the 1146 bp EcoRI-HindIII fragment was isolated by gel electrophoresis and cloned into EcoRI and HindIII cleaved pBR322 (SEQ ID NO:377).

To initiate construction of the pPAIST-7 expression plasmid, the subclone in the pBR322 vector was cleaved with EcoRI and the linear plasmid was dephosphorylated using bacterial alkaline phosphatase. Using a 360 bp EcoRI DNA fragment from pC5A-48 containing the trp promoter and ribosome binding site the pPAIST-7 was generated following standard ligation.

To generate the pPAIST7HS prokaryotic expression vector (Shubeita et al. (1990) *J. Biol. Chem.*, 265: 18379-18385), the pPAIST7 was partially digested with HindIII to linearize the plasmid, blunt-ended with the Klenow fragment of *E. coli* DNA polymerase I and ligated to eliminate the upstream HindIII site. Deletion of sequences in pPAIST7 downstream of the PAI-1 coding sequences between the HindIII and SalI sites and elimination of the SalI site was accomplished by sequential partial SalI digestion, complete HindIII digestion, blunt-ending with the Klenow fragment of *E. coli* DNA polymerase I, and ligation.

Mutagenesis reaction was carried out using the Multi site mutagenesis kit (Stratagene) following conditions specified by the supplier. Mutagenesis of amino acids in wild-type PAI-1 at positions P4-P1' in the reactive center loop corresponding to amino acids VSARM (SEQ ID NO:378) were made. A mutant PAI-1 was made (PAI-1/RRAR) containing replacement of the wild-type amino acid sequence VSARM with RRARM (SEQ ID NO:379) sequences in the PAI-1 reactive center loop from the P4 to P1' positions. The sequence of the RRARM mutagenic primer was: 5'-CCACAGCTGTC ATAAGGAGGGCCAGAATGGCCCCCGAGGAGATC-3' (SEQ ID NO:380). A second mutant PAI-1 was made (PAI-1/69) containing replacement of the wild-type amino acid sequence VSARM with PFGRS (SEQ ID NO:389) sequences in the PAI-1 reactive center loop from the P4 to P1' positions. The sequence for the PFGRS mutagenic primer was: 5'CCACAGCTGTC ATACCCTTCGGCAGAAGCGCCCCCGAGGAGATC-3' (SEQ ID NO:390). Following mutagenesis, the DNA isolated from the transformants was fully sequenced to confirm the presence of desired mutations and the absence of any additional mutations.

The mutants PAI-1/RRAR and PAI-1/69 were expressed as fusion proteins utilizing N-terminal poly histidine residues present in the pPAIST7HS vector. The expression and purification of mutant PAI-1s (i.e. PAI-1/RRAR and PAI-1/69) were based on methods as described in Ke et al. (*J. Biol. Chem.*, 272: 16603-16609 (1997)). Expression of wild type and mutated variants of PAI-1 was accomplished by transforming 0.1 µg DNA of pPAIST7HS vector encoding mutant PAI-1 into the *E. coli* strain BL21[DE3]pLys$^s$ (Novagen), which synthesizes T7 RNA polymerase in the presence of isopropyl-1-thio-β-D-galactopyranoside. Bacterial cultures were grown at 37° C. with vigorous shaking to an absorbance $A_{595}$ of 1.1-1.3, and isopropyl-1-thio-β-D-galactopyranoside was added to a final concentration of 1 mM to induce the synthesis of T7 RNA polymerase and the production of PAI-1 proteins. Cultures were grown for an additional 1-2 h at 37° C. and then shifted to 30° C. for 2-6 h. Cells were pelleted by centrifugation at 8000×g for 20 min at 4° C. and resuspended in 40 ml of cold start buffer (20 mM sodium acetate, 200 mM NaCl, and 0.01% Tween 20, pH 5.6). The cell suspension was disrupted in a French pressure cell (Aminco), and cellular debris was removed by ultracentrifugation for 25 min at 32,000×g.

Purification of soluble, active mutant PAI-1 was performed by injecting the lysate of *E. coli* containing soluble form of PAI-1/RRAR or PAI-1/69 onto an XK-26 column (Pharmacia Biotech Inc) packed with CM-50 Sephadex (Pharmacia, see e.g., Sancho et al. (1994) *Eur. J. Biochem.* 224, 125-134). The column was washed with 5 column volumes of start buffer (20 mM sodium acetate, 200 mM NaCl, and 0.01% Tween 20, pH 5.6), and PAI-1 proteins were eluted using a 0.2-1.8 M linear gradient of NaCl in the same buffer. Peak fractions were collected, pooled, and concentrated using a centriplus 30 concentrator (Amicon). The concentrated fractions were used for activity measurement.

B. PAI-1 Activity Measurements

1. Active Site Titration Against Standard Trypsin

Active concentration of PAI-1/RRAR and PAI-1/69 was determined by active site titration against standard trypsin as described by Olson et al. (*J. Biol. Chem.*, 270: 30007 (1995)). Briefly, sequential additions of concentrated inhibitor (0.5-6.0 µM) were made to solutions of 1 µM β-trypsin (Sigma) and 10 µM p-aminobenzamidine probe (Sigma). Binding was monitored from the decrease in fluorescence accompanying the displacement of the bound probe from the enzyme active site as the inhibitor bound. After addition of each concentrated inhibitor a 1-2 minute equilibration time was allowed before assessment of fluorescence changes at excitation and emission wavelengths of 325 nm and 345 nm, respectively, to maximize the difference between bound and free probe fluorescence. Control titrations of just the probe with the inhibitor in the absence of the trypsin enzyme were performed to correct for background fluorescence. Inhibitor-enzyme titrations were fit by linear regression analysis.

2. Titration of Standardized t-PA Preparations

Mutant PAI-1s were also titrated against standardized t-PA preparations to assess activity. The inhibitory activity of wild-type PAI-1 or mutant PAI-1 was measured by a direct chromogenic assay using tPA (American Diagnostics, Inc, 100 U/µg) and the chromogenic tPA substrate H-D-Ile-Pro-Arg-para-nitroaniline substrate (S-2288, Chromogenix). Serially diluted PAI-1 (0.1-4.0 µg) were incubated with tPA in a microtiter plate for a fixed time (typically, 20-60 minutes) at room temperature and the residual activity of tPA was measured by the addition of the chromogenic substrate S-2288 to a final concentration of 0.5 mM. The residual activity of t-PA following incubation with increasing concentrations of inhibitor was assessed by measuring the absorbance at 405 nm.

Example 2

Construction of Phage Display Libraries of u-PA Variants

A. Cloning Of Wild-type U-Pa Into Phagemid

To demonstrate functional display of the protease domain of u-PA on phage, high fidelity PCR was performed using primers 496 and 497, Pfu DNA polymerase and pCMV4 plasmid (SEQ ID NO:373) containing c-DNA of full length u-PA gene (SEQ ID NO:474) as a template. The primers used in the PCR amplification were as follows: 496, 5'-ACGT GGCCCAGGCGGCCTTTCAGTGTGGCCAAAAG-3' (SEQ ID NO:374); 497, 5'-TCCT GGCCGGCCTGGCCGAGCAGGCCATTCTC-3' (SEQ ID NO:375). Both the primers carry restriction sites (underlined) for SfiI enzyme at the 5' terminus. After purification and SfiI digestion, the PCR product was ligated to SfiI digested phagemid vector, pComb3H (SEQ ID NO:376) (Andris-Widhopf et al. (2000) *J Immunol Methods*, 28: 159-81). The phagemid was used for monovalent display of wild type or mutant u-PA (see below). This construct contains sequences encoding the C-terminal region of the gIIIp gene of fd phage. The presence of two SfiI restriction sites in the vector with two different recognition sequences was exploited for designing the above-mentioned primers. The PCR products amplified using primers 496 and 497 enabled directional cloning of the u-PA protease domain cDNA (SEQ ID NO:475) into the phagemid (see below for ligation conditions). In the final construct, the PCR products containing sequences of the u-PA protease domain were cloned in the middle of OmpA and gIIIp sequences to display wild-type or mutant uPA as an N-terminal gIIIp fusion.

B. Construction of Mutant u-PA and Phage Display Libraries of Mutant u-PA

To construct u-PA phage display libraries, error-prone PCR amplification was carried out using the pCMV4/u-PA plasmid containing cDNA of the uPA gene as template, as set forth above, for 25 cycles in 100 µl reaction mixtures using reagents supplied with the PCR Diversify mutagenesis Kit (Clontech). Appropriate PCR conditions were followed to set up three different PCR reactions to amplify only the protease domain of the uPA gene (SEQ ID NO:475) using primers 496 and 497 from above by varying the amounts of manganese (MN2+) or dGTP as described by the manufacturer, to achieve 0.2, 0.5, or 0.9% of mutation rate incorporation into the cDNA. The amplified PCR products (805 bp, SEQ ID NO:475) were purified using a PCR purification kit (Qiagen) followed by SfiI enzyme digestion. The SfiI digested PCR products from each mutatgenesis reaction were used to generate three different libraries.

For library construction, the pComb3H vector (SEQ ID NO:376) was digested with SfiI enzyme and the larger DNA fragment from this reaction was gel purified using a "Gel slice kit" (Qiagen). Three separate ligation reactions were carried out to construct three libraries with PCR products containing 0.2, 0.5 and 0.9% mutation rates. At least 1 µg of the gel purified vector was mixed with SfiI digested PCR products (1:2 ratio) and the ligation mixtures were incubated overnight at 18° C. Next, the ligation mixtures were purified using Qiagen mini elute kit (Qiagen) and the DNA was finally eluted into 60 µl of Milli Q purified water. The purified DNA was electroporated into 400 µl of *E. coli* XL Blue1 electroporation competent cells (Stratagene) using gene pulser (Bio Rad). The cells were then transferred to 10 ml of SOC medium (Invitrogen) and incubated at 37° C. in a shaker for 1 hr followed by plating on large LB agar plates (245 mm×245 mm) supplemented with carbenicillin (75 µg/mL). After overnight incubation of plates at 30° C. the transformants were scraped using a cell scraper and the resulting cultures were grown in 2×YT medium supplemented with carbenicillin (75 µg/ml) at 37° C. shaking for 2 hours. The cultures were infected with helper phage (VCS M13) at an MOI (multiplicity of infection) of 5 for amplification of the libraries. After 1 hour of growth at 37° C. shaking, the cultures were supplemented with kanamycin to final concentrations of 3 µg/mL and grown overnight at 30° C. with shaking. The cells were harvested and the phage particles present in the supernatant were precipitated using a PEG-NaCl solution. Simultaneously, to calculate the diversity of each library, an aliquot of the electroporated cells were plated on LB agar plates supplemented with carbenicillin (100 µg/ml) and after overnight incubation at 37° C. the colonies were counted. The same methods were used to generate successive generations of u-PA phage display libraries for further improvement of identified u-PA variants against PAI-1/RRAR inhibitor. The DNA of u-PA variants identified from the previous libraries was used as template for construction of next generation libraries.

The catalytic efficiencies of wild type or u-PA phage libraries generated using random mutagenesis were analyzed using the indirect plasminogen activation assay. Briefly, 5 µl of u-PA phage (typically ~5×10$^{12}$ cfu), 0.2 µM Lys-plasminogen (American Diagnostic) and 0.62 mM Spectrozyme PL (American Diagnostica) were present in a total volume of 100 µl. Assays were performed in microtiter plates, and the optical density at 405 nm was read every 30 seconds for 1 h in a Molecular Devices Thermomax. Reactions were performed at 37° C. Inhibition of u-PA or u-PA variant phage also was assessed. Briefly, 5 µl of u-PA phages (typically ~5×10$^{12}$ cfu) were mixed with wt-PAI-1 (0.1 µM) or mutant PAI-1/RRAR inhibitor (1.0 µM) and incubated for 30 min at room temperature followed by addition of 0.62 mM Spectrozyme PL, 0.2 µM Lys-plasminogen (American Diagnostics, Inc.). The assays were read as mentioned above.

Example 3

Selection of Variant u-PA from u-PA Phage Libraries Against Mutant Inhibitor

A. Selection of u-PA Phage/Mutant PAI-1 Complexes

Mutant PAI-1/RRAR inhibitor or PAI-1/69 were used as the "bait substrate" in the panning experiment to isolate altered u-PA phage/s with improved reactivity towards the mutant substrate sequence from large, combinatorial u-PA phage display libraries described in Example 2 above. In brief, 5 µl (~2×10$^{12}$ to ~1×10$^{13}$) u-PA phage, containing an equal representation of u-PA phage from all three u-PA phage libraries (0.2, 0.5 and 0.9% mutagenesis frequency), was mixed with 5 µl bait substrate (from 0.1 to 1.0 µM PAI-1/RRAR or PAI-1/69) and 10 µl 10× indirect buffer pH 7.4 (0.5 M Tris, 1.0 M NaCl, 10 mM EDTA, 0.1% Tween 80) in a total volume of 100 µl (i.e. reaction contained 80 µl H$_2$O). The reaction was incubated for varying times at room temperature (typically 1 hour, however, incubation time was adjusted to control the stringency of the solution).

The u-PA phage-PAI-1 inhibitor complexes were captured using CuSO$_4$ activated sepharose. Pre-activation of the chelating sepharose (200 µl; Pharmacia) was accomplished by treatment with CuSO$_4$ (100 mM). The CuSO$_4$ activated sepharose was blocked with 0.5% BSA in PBS buffer for 1 hour at room temperature. 100 µl of BSA blocked sepharose beads was added to 100 µl of the above panning mixture reaction in the presence of 800 µl of binding buffer (0.5 M NaCl, 20 mM Tris, 20 mM immidozole, pH7.4) to capture the His-tagged PAI-1 inhibitor-u-PA phage complexes. The incubation was continued for another 1 hour at room temperature. Next, the panning mixture was centrifuged for 1 min at 2000 rpm and the sepharose beads containing bound u-PA phage-PAI-1 inhibitor complexes were washed with 1 ml of binding buffer to remove unbound phages. The washing step was repeated 5-10 times and the beads containing bound complexes were transferred to new tubes after each wash to avoid any potential "carry over" of non-specific phages.

The bound u-PA phage-PAI-1/RRAR complexes were eluted in 100 µl of elution buffer (0.5M EDTA). A 95 µl aliquot of the eluted phages was used to infect 1 ml of XL-1 Blue E. coli cells (0.6 OD) to calculate the output of the libraries (indicating the number of phage obtained after selection). The infected bacteria were plated on large plates (245 mm×245 mm) containing carbenicillin (75 µg/ml) to generate a library for the next round of selection. Finally, the remaining output library (i.e. selected phage) was used to prepare individual phage clones for screening and/or generating a new library for the next round of selection. The concentrations of bait substrate used in the selection and times of incubation of the library with the bait substrate were adjusted according to the desired stringency level. For example, conditions could be chosen such that <1%, 2%, 5%, 10%, or greater than 10% of the u-PA activity of the library was inhibited by the "bait PAI-1" containing the bait substrate sequence. Typically, the first round of selection was carried out using higher (e.g., 0.5 µM) concentrations of bait PAI-1 and for successive rounds of selection the bait serpin concentration and incubation time with libraries were reduced. In addition, multiple stringencies can be used in parallel at each round of selection. Based on the quality of the output (e.g., signal to noise ratio of the phage output in paired +/−bait serpin selections (see description below)), and the quality of the resulting "hits" based on functional analysis, the phage output from one or more of these selections can be carried forward into the next round(s) of selection.

In parallel, control experiments were performed using the above-mentioned conditions for selection of phage from the u-PA library without bait and the phage from this control experiment was compared with the output of the library selections in the presence of bait serpin substrate. The cfu from the output of library selected in the presence of bait was normally in the range of $10^4$ to $10^5$ higher than the output obtained from the control selection. If higher background was observed with the control selection, the panning was repeated using more stringent conditions such as reducing incubation times, increasing concentrations of reactants (library, bait or beads) and increasing number and time of washing the selected phage bound to chelating sepharose (up to a factor of 10 or more).

B. Screening of u-PA Phages with Increased Reactivity and Catalytic Efficiency Towards New Substrate Sequences An aliquot of eluted u-PA phages (5 µl) was mixed with XL-1Blue E. coli cells (100 µl) for infection and incubated at 37° C. for 1 hr. The infected E. coli cells were then plated on LB agar plates supplemented with carbenicillin (100 µg/ml). After overnight incubation at 37° C., individual colonies were picked for phage preparations. The cells were grown in 2 ml of 2×YT supplemented with carbenicillin (100 µg/ml) and tetracycline (10 µg/ml) and phage preparation was performed as described (Sambrook, J et al (1989) Molecular Cloning, A laboratory manual, Cold spring Harbor laboratory). The identified phage were tested in the following assays to assess activity. The individual phage preparations were used in the indirect plasminogen activation assay to identify active phages, and the active phage preparations were used for inhibition assays.

1. Indirect Plasminogen Activation Assay

The individual phage preparations were used in the indirect plasminogen activation assay to identify active u-PA phages. Briefly, 5 µl of u-PA phage (typically ~5×10$^{12}$ cfu), 0.2 µM Lys-plasminogen (American Diagnostic) and 0.62 mM Spectrozyme PL (American Diagnostica) were present in a total volume of 100 µl. Assays were performed in microtiter plates, and the optical density at 405 nm was read every 30 seconds for 1 h in a Molecular Devices Thermomax. Reactions were performed at 37° C.

2. Inhibition of u-PA Phage by Mutant PAI-1/RRAR

The phage that were identified as active in the indirect plasminogen activity assay were further tested for inhibition by mutant PAI-1/RRAR. Briefly, for the inhibition assays, 5 µl of active u-PA phages (typically ~5×10$^{12}$ cfu) were added in duplicate wells of a microtiter plate followed by addition of a fixed concentration of mutant PAI-1 (e.g., 1.0 µM) to one well and phosphate buffered saline (PBS) to the duplicate well. After mixing, the reaction was allowed to continue for a fixed time (e.g., 30 min) at room temperature followed by addition of 0.62 mM Spectrozyme PL, 0.2 µM Lys-plasminogen (American Diagnostics, Inc.). For control experiments, wild-type u-PA phage was assessed under the same conditions. The plates were read at 405 nm in a spectrophotometer for 2 hrs. The selected u-PA phages that exhibited improved sensitivity for PAI-1/RRAR or PAI-1/69 as compared with wild-type u-PA phage were selected for further analysis and subjected to DNA sequencing.

3. Peptide Substrate Screening

In addition, to identify variants of u-PA phage with improved catalytic efficiency the individual phage clones were screened against an Ac-RRAR-AMC substrate. For the assay, a fixed volume of phage supernatants (e.g., 35 µl) was mixed with 75 µM Ac-RRAR-AMC substrate in IX indirect assay buffer (50 mM Tris, 100 mM NaCl, 1 mM EDTA, 0.01% Tween 80) in a total volume of 100 µl. The assay was carried out in 96-well or 384-well black assay plates (Corning) and read at 380-450 nm for 2 hrs in spectrophotometer (Molecular Devices) reader.

To confirm their improvement, the positive u-PA phages identified after inhibitor and peptide substrate screenings were re-screened using the assays set forth above.

C. Identification of Selected u-PA Mutants and Optimization of Identified Mutants Positive phage clones were mixed with XL-1Blue E. Coli cells for infection as mentioned above and the cultures were grown overnight with shaking at 37° C. Plasmid DNA was purified from the overnight culture using a plasmid preparation kit (Qiagen). The DNA was sent for custom sequencing using the following primers: 535-5'-CAGCTATCGCGAT-TGCAG-3' (SEQ ID NO:381); 5542-5'GTGCGCAGC-CATCCCGG-3' (SEQ ID NO:382). Amino acid residues altered in the mutant u-PA genes were identified after analyzing the sequencing data.

Table 10 below sets forth variants of u-PA identified from selection of variant u-PA from u-PA phage libraries against a PAI-1/RRAR mutant inhibitor. The mutations set forth in Table 10 below are with chymotrypsin numbering. The numbers in parentheses indicate the number of times the mutants were identified in the phage selection method. Based on results from activity assays, the best variants of u-PA phages are highlighted by underline. Amino acid sequences of a mature u-PA preproprotein (SEQ ID NO:433) containing the designated mutations are set forth in any of SEQ ID NOS: 434-445.

TABLE 10

| u-PA Phage libraries Vs PSI-1/RRAR | Mutant name | Mutation site/s (Chymotrypsin Number) | Amino acid/s modified | SEQ ID NO: |
|---|---|---|---|---|
| Selection I | AR73 (2) | 30 | Phe-Ileu | 434 |
|  | AR81 | 73, 89 | Leu-Ala, Ileu-Val | 435 |
| Selection II & III | AR1 | 73 | Leu-Pro | 436 |
|  | AR3 | 217 | Arg-Cys | 437 |
|  | AR4 (3) | 155 | Leu-Pro | 438 |
|  | AR7 | 75, 89, 138 | Ser-Pro, Ileu-Val, Ileu-Thr | 439 |
|  | AR32 | 137 | Glu-Gly | 440 |
|  | AR36 | 72, 155 | Arg-Gly, Leu-Pro | 441 |
|  | AR37 | 133 | Gly-Asp | 442 |
|  | AR66 | 160 | Val-Ala | 443 |
|  | AR24 | 38 | Val-Asp | 444 |
|  | AR85 | 132, 160 | Phe-Leu, Val-Ala | 445 |

Amino acid residues altered in the mutant u-PA gene exhibiting increased sensitivity against PAI-1/69 inhibitor following selection against the PAI-1/69 inhibitor were identified after analyzing the sequencing data as set forth above. The mutants identified from the first generation protease phage display library (I) are set forth below in Table 11. theses indicate the number of times u-PA phage were selected for that had the same mutation. The underline indicates the new mutations acquired by the mutant. Amino acid sequences of a mature u-PA preproprotein (SEQ ID NO:433) containing the designated mutations are set forth in any of SEQ ID NOS: 460-472.

TABLE 11

| Phage libraries | Mutant name | Mutation sites | Amino acids modified | SEQ ID NO: |
|---|---|---|---|---|
| I | u-PA/Ia | 21 | Phe-Val | 460 |
|  | u-PA/Ib | 24 | Ile-Leu | 461 |
|  | u-PA/Ic (2) | 30 | Phe-Val | 462 |
|  | u-PA/Id | 30 | Phe-Leu | 463 |
| II | u-PA/IIa | 30, 61(A) | Tyr-His | 464 |
|  | u-PA/IIb | 30, 82 | Lys-Glu | 465 |
|  | u-PA/IIc | 30, 156 | Lys-Thr | 466 |
| III | u-PA/IIIa (8) | 30, 82, 159 | Val-Ala | 467 |
|  | u-PA/IIIb | 30, 82, 39, 159 | Thr-Ala, Val-Ala | 468 |
|  | u-PA/IIIc | 30, 82, 158, 159 | Thr-Ala, Val-Ala | 469 |
|  | u-PA/IIId (2) | 30, 61A, 92 | Lys-Glu | 470 |
| IV | u-PA/IVa | 30, 82, 159, 80, 89, 187 | Glu-Gly, Ile-Val, Lys-Glu | 471 |
|  | u-PA/IVb | 30, 82, 159, 80, 84, 89, 187 | Glu-Gly, Glu-Lys, Ile-Val, Lys-Glu | 472 |

Subsequent generations of protease phage display libraries were created using the method as set forth above in Example 2B using the PCR Diversify mutagenesis kit and primers 496 and 497. For the generation II phage display library, the u-PA mutant u-PA/Ic containing a mutation corresponding to F30V based on chymotrypsin numbering was used as a template for the mutagenesis reaction. The mutants identified from the second generation protease phage display library (II) are set forth in the Table 11 below. For the generation III phage display library, the u-PA mutant u-PA-IIb or u-PA-IIb mutant containing mutations corresponding to F30V/Y61(A)H or F30V/K82E, respectively, based on chymotrypsin numbering were used as templates for the mutagenesis reaction. The mutants identified from the third generation protease phage display library (III) are set forth in Table 11 below. For the generation IV phage display library, the u-PA mutant u-PA/IIIa containing mutations corresponding to F30V/K82E/V159A based on chymotrypsin numbering was used as a template for the mutagenesis reaction. The mutants identified from the fourth generation protease phage display library (IV) are set forth in Table 11 below. The numbers in paren- 1. Optimization and Recombination of Amino Acid Resides 30 and 155 in Focused Phage Display Libraries against PAI-1/RRAR Inhibitor To enrich the sensitivity of u-PA variants against the PAI-1/RRAR inhibitor, amino acid 30 and amino acid 155 based on chymotrypsin numbering (identified as hot spots in the first selections as set forth in Table 10 above) were targeted for randomization and recombination using the following primers, respectively: TC30-5'GCCCTGGNNSGCGGCCATC-3' (SEQ ID NO:383) TC155-5'GGAGCAGNNSAAAAT-GACTG-3' (SEQ ID NO:384)

Mutagenesis was performed using the Quick Change multi site-directed mutagenesis kit (Stratagene) following conditions described by the manufacturer. In brief, after phosphorylation of the primers using T4 polynucleotide kinase (New England Biolabs) following conditions described by the manufacturer, three different reactions were performed for randomization of residues 30 and 155: 1) 30 individually; 2) 155 individually; and 30 plus 155 together. The DNA construct, pComb3H/u-PA variant (pARF 81), carrying muta tions at residues L73A and I89V as compared to the corresponding wild type u-PA protease domain sequences, was used as a template in the mutagenesis reaction using primers TC30 (SEQ ID NO:383) and TC155 (SEQ ID NO: 384) individually for randomization of positions 30 and 155 respectively. In another reaction, these two primers were used to randomize positions 30 and 155 together in the pARF 81 variant DNA. Mutagenesis reaction was carried out using the Multi site mutagenesis kit (Stratagene) following conditions specified by the supplier. After mutagenesis, the reaction products were transformed into XL-1 Blue E. coli cells for library construction (See Example 2 above). The amplified u-PA phage libraries were used for selection of improved variants of u-PA as set forth in Example 3A and 3B above.

Table 12 below sets forth variants of u-PA identified from selection against a PAI-1/RRAR mutant inhibitor of variant u-PA from focused u-PA phage libraries where all variants had background mutations at amino acid residues L73A and I89V based on chymotrypsin numbering. The mutations set forth in Table 12 below are with chymotrypsin numbering. The numbers in parentheses indicate the number of times the mutants were identified in the phage selection method. Based on results from activity assays, the best variants of u-PA phages are highlighted by underline. Amino acid sequences of a mature u-PA preproprotein (SEQ ID NO:433) containing the designated mutations are set forth in any of SEQ ID NOS: 446-459.

TABLE 12

| Focused u-PA libraries Vs PAI-1/RRAR | Mutant Name | 30 (Phe) | 155 (Leu) | SEQ ID NO |
|---|---|---|---|---|
| Selection I & II | ARF2 | Thr | — | 446 |
| | ARF6 | Leu | — | 447 |
| | ARF11 | Val | — | 448 |
| | ARF17 | Gly | — | 449 |
| | ARF16 | Leu | — | 450 |
| | ARF33 | — | Val | 451 |
| | ARF35 | Met | — | 452 |
| | ARF36 | — | Met | 453 |
| | ARF37 | Met | — | 454 |
| | ARF43 | Leu | — | 455 |
| | ARF47 | Val | — | 456 |
| | ARF48 | Leu | Met | 457 |
| | ARF103 | Leu | — | 458 |
| | ARF115 | Gly | Met | 459 |

Example 4

Expression of Modified u-PA Enzymes by Transient Transfection of COS Cells

For the expression of variant u-PA enzymes in a mammalian expression system, the positive clones identified from phage display results were used as a template (pComb3H carrying mutant u-PA protease domain sequences) for PCR amplification of cDNA encoding the selected u-PA variant gene. Overlap extension PCR (Ho, S et al (1989) Gene 77, 51-59) was carried out using the following primers. 717-5'-TTTCAGTGTGGCCAAAAG-3' (SEQ ID NO:385); 718, 5'-CAGAGTCTTTTGGCCACA-3' (SEQ ID NO:386); 850, 5'-GG GGTACCGCCACCATGAGAGCCCTGCTGGCGCGC-3' (SEQ ID NO:387); 851, 5'-GC TCTAGATCATCAGAGGGCCAGGCCATTCTCT-3' (SEQ ID NO:388). The primers 850 and 851 carry sequences for KpnI and XbaI restriction enzymes (underlined) respectively.

PCR was performed in two steps to accomplish full-length amplification of mutated cDNA u-PA gene as described below. In the first step, PCR was carried out in a 100 μl reaction to amplify a 500 bp product (corresponding to the EGF and Kringle domains of u-PA) using Pfu DNA polymerase, primers 850, 718 and pCMV4 containing the full-length uPA gene (SEQ ID NO:474) as template. Similarly, another PCR was carried out to amplify the mutant u-PA protease domain (800 bp, i.e. corresponding to mutant sequences as compared to the wild-type sequence set forth in SEQ ID NO:475) using primers 851 and 717 with the appropriate mutant u-PA-pComb3H as template. These two PCR products were gel purified and used in the next round of PCR amplification. In the second step, the gel purified PCR products (5 μl each) were used as templates in 100 μl reaction mixture with primers 850 and 851. The primers 717 and 718 have overlapping complementary sequences that allowed the amplification of the full-length u-PA cDNA (1.3 kb) in the second step PCR. The PCR product was purified using a PCR purification kit (Qiagen) and then digested with KpnI and XbaI restriction enzymes. After purification using QIAquick columns (Qiagen), the full-length u-PA gene was ligated with the pCMV4 mammalian expression vector (SEQ ID NO:373) that had been previously digested with KpnI and XbaI. The ligation mixture was electroporated into E. coli XL-1 Blue cells and plated on LB plates supplemented with carbenicillin (100 μg/ml). After overnight incubation of plates at 37° C., individual colonies were picked up and grown in 2 ml LB medium for plasmid purification. The plasmids were used for sequencing the entire u-PA gene using the following sequencing primers. UPAF1-5'ATGAGAGCCCTGCTG-GCGCGCC-3' (SEQ ID NO:476) and UPAF2-5'GGAAAA-GAGAATTCTACCG-3' (SEQ ID NO:477).

Mutant u-PA clones with the correct mutations, without any additional mutation(s), were prepared in large quantities using Midi Plasmid preparation kit (Qiagen) and used for electroporation into COS-1 cells using a Bio-Rad Gene Pulser. 20 μg of cDNA, 100 μg of carrier DNA, and approximately $10^7$ COS-1 cells were placed into a 0.4-cm cuvette, and electroporation was performed at 320 V, 960 microfarads, and Ω=∞ (Tachias et al. (1995) J. Biol. Chem., 270: 18319-18322). Following electroporation, the transfected cells were incubated overnight at 37° C. in DMEM medium (Irvine Scientific) containing 10% fetal calf serum and 5 mM sodium butyrate. Cells were then washed with serum free medium and incubated in DMEM for 48 h at 37° C. After incubation with serum-free media, conditioned media was collected and used for further characterization.

Example 5

Characterization of Purified Mutant u-PAs

A. Measurement of Enzyme Concentration

The single-chain form of the mutant u-PA enzymes in conditioned media was converted into the corresponding two-chain enzyme by treatment with plasmin-sepharose (Calbiochem). The concentration of active u-PA in these media was measured by active site titration with a standard PAI-1 inhibitor preparation that had been previously titrated against a trypsin primary standard as described in Example 1 above. Total enzyme concentrations were measured by enzyme-linked immunosorbent assay following the protocols of laboratory manual, Harlow et al (1998) Using Antibodies, Cold Spring Harbor Laboratory. The ratio of these concentrations yields the fraction of u-PA variant that is active in each media.

B. Direct Chromogenic Assay of u-PA

Direct assays of u-PA activity utilized the substrate carbobenzoxy-L-γ-glutamyl (α-t-butoxy)-glycyl-arginine-p-nitroanilide monoacetate salt (Cbo-L-(γ)-Glu(α-t-βuO)-Gly-Arg-pNA AcOH; Spectrozyme® uPA, American diagnostica) (Madison et al. (1995) *J. Biol. Chem.*, 270:7558-7562). Enzyme activity was determined by measuring the increase in absorbance of the free (pNA) generated per unit time at an absorbance of 405 nm. Kinetic assays were performed over time using enzyme concentrations between 6 and 8 nM. The concentration of Spectrazyme® uPA was varied from 25 to 150 µM in assays of two-chain u-pA, and from 25 to 200 µM in assays of the protease domain of u-PA. Reactions were performed in 96-well microtiter plates and reaction rates were assessed by measurement of absorbance at 405 nm every 30 seconds for up to 2 hours using a Spectromax M2 or M5 plate reader (Molecular Devices). The kinetic constants $k_{cat}$, $K_m$, and $k_{cat}/K_m$ (specificity constant) were calculated by graphing the inverse of the substrate concentration versus the inverse of the velocity of absorbance at $OD_{405}$, and fitting to the Lineweaver-Burk equation $(1/\text{velocity}=(K_m/V_{max})(1/[S])+1/V_{max}$; where $V_{max}=[E]*k_{cat})$.

Table 13 below set forth the results of kinetic analysis of mutants of u-PA, identified as exhibiting increased sensitivity against PAI-1/69 inhibitor, in a direct assay of u-PA enzyme activity. The results show that each of the mutant u-PAs identified have a decreased enzyme activity as compared to wild-type u-PA as determined from the measurement of the specificity constant for cleavage (kcat/Km) of the Spectrozyme® uPA substrate. In the Table, the variants tested are those identified in Table 11 above following selection from successive generations (I to IV) of u-PA phage display libraries.

TABLE 13

| u-PA mutants | $K_m$ (mM) | $k_{cat}^{(s-1)}$ | $k_{cat}/K_m^{(M-1\,s-1)}$ | Mutant/Wt u-PA |
|---|---|---|---|---|
| u-PA/Ic (30) | 0.745 | 22.3 | $2.9 \times 10^5$ | 0.30 |
| u-PA/IIb (30, 82) | 0.299 | 11 | $3.6 \times 10^5$ | 0.38 |
| u-PA/IIIa (30, 82, 159) | 0.239 | 11.6 | $4.8 \times 10^5$ | 0.50 |
| u-PA/IIIb (30, 39, 82, 159) | 0.212 | 9.6 | $4.5 \times 10^5$ | 0.47 |
| u-PA/IVa (30, 80, 82, 89, 159, 187) | 0.177 | 10 | $5.6 \times 10^5$ | 0.58 |
| u-PA/IVb (30, 80, 82, 84, 89, 159, 187) | 0.321 | 11 | $3.4 \times 10^5$ | 0.35 |
| Wild type u-PA | 0.174 | 16.6 | $9.5 \times 10^5$ | 1.0 |

C. Kinetic Analysisi of u-PA Variants using Fluorogenic Substrate

Direct assays for measuring activity of the u-PA variants against the RRAR target substrate sequence were performed utilizing an Ac-RRAR-AMC substrate. The use of 7-amino-4-methylcoumarin (AMC) fluorogenic peptide substrate is a routine method for the determination of protease specificity (Zimmerman et al. (1977) *Anal Biochem*, 78:47-51; Harris et al. (2000) *PNAS*, 97:7754-7759). Specific cleavage of the anilide bond frees the fluorogenic AMC leaving group, providing an efficient means to determine the cleavage rates for individual substrates. The substrates were serially diluted from 0.05 to 12.0 mM and incubated in the presence of protease (9-25 nM) in a Costar 96-well black half-area assay plate. The fluorescence from the free AMC leaving group was measured in a fluorescence spectrophotometer (Molecular Devices Gemini XPS) at an excitation wavelength (380 nm) and emission wavelength (450 nm) with reference to an AMC standard. The rate of increase in fluorescence was measured over 30 minutes with readings taken at 30 second intervals. The kinetic constants $k_{cat}$, $K_m$, and $k_{cat}/K_m$ (specificity constant) were calculated by graphing the inverse of the substrate concentration versus the inverse of the velocity of substrate cleavage, and fitting to the Lineweaver-Burk equation $(1/\text{velocity}=(K_m/V_{max})(1/[S])+1/V_{max}$; where $V_{max}=[E]*k_{cat})$.

Table 14 below sets forth the results of the kinetic analysis of the u-PA variants ARF2 and ARF36 against the Ac-RRAR-AMC substrate. The results show that the specificity constant for the RRAR substrate for the selected u-PA protease variants are increased about or more than 10-fold as compared to wild-type u-PA.

TABLE 14

| Mutants | $K_m$ (µM) | $K_{cat}/K_m$ (M$^{-1}$ s$^{-1}$) | Improvement of $K_{cat}/K_m$ mutant/Wt u-PA |
|---|---|---|---|
| u-PA/ARF2 | 546 | 434 | 11.7 |
| u-PA/ARF36 | 614 | 357 | 9.6 |
| Wt u-PA | 381 | 37 | 1.0 |

D. Kinetic Analysis of Plasminogen Acativation using an Indirect Chromogenic Assay An indirect chromogenic assay was performed to determine the activities of the wild-type and mutant u-PA produced as purified protein preparations (Madison et al. (1989) *Nature*, 339: 721-724; Madison et al. (1990) *J. Biol. Chem.*, 265: 21423-21426). In this assay, free p-nitroaniline is released from the chromogenic substrate Spectrozyme PL (H-D-norleucylhexahydrotyrosyl-lysine-p-nitroanilide diacetate salt, American Diagnostics, Inc.) by the action of plasmin generated by the action of u-PA on plasminogen. The release of free p-nitroaniline was measured spectrophotometrically at $OD_{405}$ nm.

For the assay, 100 µl reaction mixtures containing 0.25-1 ng of the uPA enzymes to be tested, 0.62 mM Spectrozyme PL, 0.2 µM Lys-plasminogen (American Diagnostics, Inc.), were combined in a buffer containing 50 mM Tris-HCL (pH 7.5), 0.1 M NaCl, 1.0 mM EDTA and 0.01% (v/v) Tween 80. The reaction was incubated at 37° C. in 96-well, flat-bottomed microtiter plates (Costar, Inc.) and the optical density at 405 nm ($OD_{405}$) was read every 30 s for 1 h in a Molecular Devices Thermomax. The kinetic constants $k_{cat}$, $K_m$, and $k_{cat}/K_m$ (specificity constant) were calculated as described earlier (Madison, E. L (1989) *Nature* 339, 721-724).

Table 15 below sets forth the results of kinetic analysis of mutants of u-PA, identified as exhibiting increased sensitivity against PAI-1/69 inhibitor, in an indirect assay of u-PA enzyme activity. The results show that each of the mutant u-PAs identified have a decreased enzyme activity as compared to wild-type u-PA as determined from the indirect measurement of the specificity constant for cleavage (kcat/Km) of cleavage of the Spectrozyme® PL substrate. In the Table, the variants tested are those identified in Table 11 above following selection from successive generations (I to IV) of u-PA phage display libraries.

TABLE 15

| u-PA mutants | $K_m$ (µM) | $k_{cat}^{(s-1)}$ | $k_{cat}/K_m^{(M-1\,s-1)}$ | Mutant/Wt u-PA |
|---|---|---|---|---|
| u-PA/Ic | 9.01 | 24.7 | $2.7 \times 10^6$ | 0.24 |
| u-PA/IIb | 8.6 | 22.6 | $2.6 \times 10^6$ | 0.23 |
| u-PA/IIIa | 6.31 | 37.6 | $5.9 \times 10^6$ | 0.53 |

TABLE 15-continued

| u-PA mutants | $K_m$ (µM) | $k_{cat}^{(s-1)}$ | $k_{cat}/K_m^{(M-1\ s-1)}$ | Mutant/Wt u-PA |
|---|---|---|---|---|
| u-PA/IIIb | 9.3 | 29.8 | $3.2 \times 10^6$ | 0.29 |
| u-PA/IVa | 7.03 | 38.7 | $5.5 \times 10^6$ | 0.50 |
| u-PA/IVb | 7.5 | 45.3 | $6.0 \times 10^6$ | 0.54 |
| Wild type u-PA | 6.03 | 70.1 | $1.1 \times 10^7$ | 1.0 |

E. Kinetic Analysis of Inhibition of Mutant u-PA Enxymes by Wild-type PAI-1 and Mutant PAI-1

The second order rate constants (ki) for inhibition of mutant and wild type u-PA (positive control) were determined using pseudo-first order (ki<$2 \times 10^6$) or second order (ki>$2 \times 10^6$) conditions. For each enzyme, the concentrations of enzyme and inhibitor (mutant PAI-1) were chosen to yield several data points for which the residual enzymatic activity varied between 20 and 80% of initial activity. Kinetic measurements on the rate of interaction of wild-type and mutant u-PA with wild-type and mutant PAI-1 was performed at 24° C. in 0.1 M Tris-HCl buffer (pH 7.4) containing 0.1 mM EDTA and 0.1% (v/v) Tween 20. The indirect chromogenic assay as described in Part D above was used to determine the residual enzyme activity remaining as a function of time.

The rate constants for inhibition of wild-type or mutant u-PA by PAI-1 were under pseudo-first order conditions for an excess of PAI-1 over u-PA as described previously (see e.g., Holmes et al. (1987) *Biochemistry*, 26: 5133-5140; Beatty et al. (1980) *J. Biol. Chem.*, 255:3931-3934; Madison et al. (1990) *PNAS*, 87: 3530-3533; Madison et al. (1993) *Methods Enzymol.*, 223:249-271). Briefly, purified wild-type or mutant u-PA (3-50 fmol) were incubated at room temperature for 0 to 120 minutes with wild-type or mutant PAI-1 (35-1330 fmol). Following incubation, the mixtures were diluted and the residual enzymatic activity was determined in a standard chromogenic assay as set forth in D above. Data were analyzed by plotting ln (residual activity/initial activity) versus time and determining the slope of the resulting straight line. Pseudo-first order rate constants were then derived by dividing the slope by the concentration of the inhibitor in the reaction.

For second order reactions, equimolar concentrations of wild-type or mutant u-PA and wild-type or mutant PAI-1 were mixed directly in microtiter plate wells and preincubated at room temperature for periods of time varying from 0 to 30 min. Following preincubation, the mixtures were quenched with an excess of neutralizing anti-PAI antibodies and residual enzymatic activity was measured in the indirect chromogenic assay. The indirect, chromogenic assays were compared with control reactions containing no PAI-1 or to which PAI-1 was added after preincubation and addition of anti-PAI-1 antibody, plasminogen and Spectrozyme PL to the reaction mixture. Data were analyzed by plotting ln (residual activity/initial activity) versus time and determining the slope of the resulting straight line. Second order rate constants were then derived by dividing the slope by the concentration of the inhibitor in the reaction.

Table 16 below sets forth second order rate constants for inhibition of u-PA variants by PAI-1/RRAR inhibitor. The results show that the variants ARF2 and ARF36 have about a 20-fold improvement in specificity for the PAI-1/RRAR inhibitor substrate as assessed by the increased ki rate constant for inhibition as compared with wild-type u-pA.

TABLE 16

| u-PA variants | $2^{nd}$ order rate constant ($M^{-1}s^{-1}$) | Improvement Mutant/Wt-uPA |
|---|---|---|
| u-PA/ARF2 | $1.6 \times 10^5$ | 18.3 |
| u-PA/ARF36 | $1.7 \times 10^5$ | 20.2 |
| Wt u-PA | $8.7 \times 10^3$ | 1.0 |

Tables 17 and 18 below are the results of second order rate constants of inhibition for wild-type (Table 17) or mutant PAI-1/69 inhibitor (Table 18) by wild-type u-PA or u-PA variants selected against the PAI-1/69 inhibitor. The variant u-PAs set forth in each of Tables 17 and 18 are those identified from one (I) to four (IV) successive rounds of a u-PA phage library selection as depicted in Table 11 above. The results in Table 17 show that some of the mutant u-PAs (i.e. u-PA/IIIa, u-PA/IIIb, and u-PA/IVa) have a slightly increased second order rate constant for inhibition as compared to wild-type u-PA and the mutants u-PA/Ic, u-PA/IIb, and u-PA/IVb have a decreased second order rate constant for inhibition as compared to wild-type u-PA. The results in Table 18 show that the second order rate constant for inhibition is dramatically increased for each of the selected u-PA variants for inhibition by the mutant PAI-1/69 inhibitor. The results show that that each of the selected variants have a greater than 13-fold improvement in specificity for the PAI-1/69 inhibitor substrate, with variants u-PA/IIIb, u-PA/IVa, and u-PA/IVb each exhibiting close to or more than a 40-fold improvement in specificity.

TABLE 17

| u-PA mutants | $2^{nd}$ order rate constant ($M^{-1}s^{-1}$) | Sensitivity factor (Mutant/Wt u-PA) |
|---|---|---|
| u-PA/Ic | $2.4 \times 10^6$ | 0.3 |
| u-PA/IIb | $2.9 \times 10^6$ | 0.3 |
| u-PA/IIIa | $9.7 \times 10^6$ | 1.2 |
| u-PA/IIIb | $1.3 \times 10^7$ | 1.6 |
| u-PA/IVa | $2.7 \times 10^7$ | 1.6 |
| u-PA/IVb | $6.8 \times 10^6$ | 0.8 |
| Wild type u-PA | $7.5 \times 10^6$ | 1.0 |

TABLE 18

| u-PA mutants | $2^{nd}$ order rate constant ($M^{-1}s^{-1}$) | Increased sensitivity factor (Mutant/Wt u-PA) |
|---|---|---|
| u-PA/Ic | $1.0 \times 10^5$ | 13.7 |
| u-PA/IIb | $1.1 \times 10^5$ | 15.3 |
| u-PA/IIIa | $1.8 \times 10^5$ | 24.5 |
| u-PA/IIIb | $2.8 \times 10^5$ | 37.5 |
| u-PA/IVa | $2.7 \times 10^5$ | 35.9 |
| u-PA/IVb | $3.2 \times 10^5$ | 42.6 |
| Wild type u-PA | $7.5 \times 10^3$ | 1.0 |

Example 6

Selection of Variant MT-SP1 from MT-SP1 Phage Libraries Against Mutant AT3 Inhibitor A mutant antithrombin III (AT3) inhibitor (SEQ ID NO:5) containing a hexapeptide sequence in the reactive site loop (RSL) residues P4-P3-P2-P1-P1'-P2' of a wildtype AT3 corresponding to amino acid residues IAGRSL (SEQ ID NO:

478) was mutated to contain a substitution in these residues to SLGRKI (SEQ ID NO:479), corresponding to the amino acid residues of a complement C2 cleavage sequence. The mutant AT3$^{SLGR-KI}$ was used as the "bait substrate" in the protease selection experiment to isolate phage with improved reactivity towards the mutant substrate sequence from a large, combinatorial MT-SP1 phage display library. In brief, for analysis of the first generation selection, 5 µl of a 1:100 SM1 (~3× 10$^{13}$) MT-SP1 phage library that is a low mutagenic frequency library (i.e., 0.2-0.5% mutagenesis frequency) that has enzymatic activity was combined in equal representation with 5 µl of a 1:100 SM2 (~3×10$^{12}$) MT-SP1 phage library that contains a higher mutagenesis frequency (i.e. 0.9%). The phage libraries were mixed with 5 µl heparin (5 ng/µl; from stock of porcine intestinal mucosa), 5 µl bait AT3$^{SLGR-KI}$ substrate (ranging in concentrations from 0 (i.e. 5 µl H$_2$O), 0.018 µM, 0.18 µM, 1.8 µM, or 18 µM) in the presence of 5 µl (18 µM) wildtype, plasma purified AT3 and 5 µl 10×MTSP activity buffer (0.5 M Tris HCl, pH 8, 0.3 M NaCl, 0.1% Tween 30) in a total volume of 50 µl (i.e. reaction contained 20 µl H$_2$O). The reaction was incubated for 4.5 hours at 37° C.

The MTSP-1 phage-AT3 inhibitor complexes were captured using CuSO$_4$ activated sepharose. 200 µl of chelating sepharose (Pharmacia) was pre-activated with CuSO$_4$ (100 mM). The CuSO$_4$ activated sepharose (100 µl) was blocked with 2 ml 0.5% BSA in PBS buffer for 1 hour at room temperature. The beads were harvested from the blocking solution by pelleting at 6500 rpm for 60 sec. followed by resuspension in 450 µl of binding buffer (0.5 M NaCl, 100 M Tris pH 8, 10 mM Imidazole, 0.1% Tween 20). 50 µl of the above panning mixture reaction was added to the CuSO$_4$ activated sepharose beads to capture the His-tagged AT3 inhibitor-MTSP-1 phage complexes. The incubation was continued for another 1 hour at room temperature. Next, the panning mixture was centrifuged for 1 min at 2000 rpm and the sepharose beads containing bound AT3 phage-MTSP-1 inhibitor complexes were washed with 500 µl of binding buffer to remove unbound phages. The washing step was repeated 5 times and the beads containing bound complexes were transferred to new tubes after each wash to avoid any potential "carry over" of non-specific phages.

The bound MT-SP 1 phage-AT3$^{SLGR-KI}$ complexes were eluted in 100 µl of elution buffer (0.5 M EDTA, pH 8.0). A 50 µl aliquot of the eluted phages was used to infect 3 ml of TG1 E. coli actively growing cells (A600=0.5; 0.5 OD=~1.5×10$^8$ colonies/ml) for 20 minutes at 37° C. The infected bacteria were plated on large plates (245 mm×245 mm) containing carbenicillin (75 µg/ml) and incubated at 30° C. overnight. The next morning the plates were harvested. The colonies on each plate were counted and compared to the background plate that contained no AT3$^{SLGR-KI}$ inhibitor. The results of the colony counts are set forth in Table 19.

TABLE 19

Results of First Generation Selection

| Concentration of AT3$^{SLGR-KI}$ in reaction | Colonies from first round of selection |
|---|---|
| 18 µM AT3$^{SLGR-KI}$ | Lawn |
| 1.8 µM AT3$^{SLGR-KI}$ | 6088 |
| 0.18 µM AT3$^{SLGR-KI}$ | 1712 |
| 0.018 µM AT3$^{SLGR-KI}$ | 3700 |
| 0 µM AT3$^{SLGR-KI}$ | 840 |

The colonies from the AT3$^{SLGR-KI}$-containing plates were scraped into 25 ml 2YT supplemented with carbenicillin (~100 µg/ml) after the plates had been placed in the cold room for 2 hours to firm up the agar. 20 ml of the 2YT bacteria containing medium was added to 500 ml 2YT containing carbenicillin and the A$_{600}$ was determined to be 0.13. The bacteria were grown to an OD=~0.5 and then ~1×10$^{10}$ to 2.6×10$^{13}$ cfu/ml of helper phage (VS M13) were added (in ~150 µl-200 µl) for amplification of the libraries. After 1 hour of growth at 37° C. shaking, the cultures were supplemented with kanamycin to final concentrations of 3 µg/mL and grown overnight at 30° C. with shaking. The cells were harvested and the phage particles present in the supernatant were precipitated using a PEG-NaCl solution. For analysis of the second generation of MT-SP1 phage selection, the conditions were similar to the first generation, except that reaction against the AT3$^{SLGR-KI}$ bait substrate was for only 27 minutes instead of 4.5 hours to enhance the stringency of the selection.

Following elution of the bound MT-SP1 phage-AT3$^{SLGR-KI}$ complexes as described above, 50 µl aliquot of the eluted phages were used to infect 3 ml of TG1 E. coli actively growing cells (A600=0.5; 0.5 OD=~1.5×10$^8$ colonies/ml) for 20 minutes at 37° C. The infected bacteria were plated on large plates (245 mm×245 mm) containing carbenicillin (75 µg/ml) and incubated at 30° C. overnight. The next morning the plates were harvested. The colonies on each plate were counted and compared to the background plate that contained no AT3$^{SLGR-KI}$ inhibitor. The results of the colony counts are set forth in Table 20.

TABLE 20

Results of Second Generation Selection

| Concentration of AT3$^{SLGR-KI}$ in reaction | Colonies from second round of selection; (background) | Enrichment Ratio Compared to Background |
|---|---|---|
| 18 µM AT3$^{SLGR-KI}$ | 2476 (165) | 15:1 |
| 1.8 µM AT3$^{SLGR-KI}$ | 1750 (90) | 19:1 |
| 0.18 µM AT3$^{SLGR-KI}$ | 2012 (110) | 18:1 |
| 0.018 µM AT3$^{SLGR-KI}$ | 1824 (89) | 21:1 |

The colonies were picked for further characterization. The cells were grown in 2 ml of 2×YT supplemented with carbenicillin (100 µg/ml) and tetracycline (10 µg/ml) and phage preparation were performed as described (Sambrook, J et al (1989) *Molecular Cloning, A laboratory manual*, Cold spring Harbor laboratory). The selected phage were tested for enzymatic activity against an Ac-SLGR-ACC substrate. Further, the selected phage were selected for resistance to inactivation by wildtype AT3 or Plasma.

Example 7

Expression and Purification of Mutant AT3 Inhibitors

A. Generation Of Variant At3

Mutant AT3 proteins for use as protease trap "bait substrates" were created by introducing modifications into the amino acid sequence of the AT3 reactive center loop (RCL) by using the coding region of human antithrombin III (AT3) gene (SEQ ID NO.: 612, purchased from Origene Technologies, Catalog #TC110831; ) as a template. The AT3 cDNA was amplified by PCR using the forward primer having the sequence of nucleic acids set forth in SEQ ID NO.: 626: GTCACTGACTGACGTGGATCCCACGG-GAGCCCTGTGGACATC (which contains a stuffer sequence (shown in bold above), a BamH1 site (shown in italics), and a portion that hybridizes to the AT3 gene (shown in plain text)), and a reverse primer having the sequence of nucleic acids set forth in SEQ ID NO.: 628: GTAGCCAAC-CCTTGTGTTAAGGGAGGCGGAAGCCAT-CACCACCATCACCA CTAAGAATTC. Following amplification, the cDNA was subcloned into the pAcGP67b baculovirus transfer vector (BD Biosciences SEQ ID NO.: 494) using restriction sites Bam and EcoRI. Either a C-terminal 6×His-tag (SEQ ID NO.: 496) or a C-terminal FLAG-tag (DYKDDDDK; SEQ ID NO.: 495) was added during this subcloning step so that AT3 mutants later could be isolated by affinity purification. The nucleotide and amino acid sequence of the cloned AT3 fusion protein, containing AT3 fused to the 6×His tag using a four amino acid GGGS linker (SEQ ID NO.:620) are set forth in SEQ ID NOs.:613 and 614, respectively.

To make mutant AT3 bait substrates for isolating target proteases with various specificities, mutagenesis reactions were carried out using the Quikchange® site-directed mutagenesis kit (Stratagene) following the conditions specified by the supplier to introduce amino acid residues of target cleavage sequences in place of the wild-type AT3 reactive center loop (RCL) sequence, IAGRSL (SEQ ID NO.: 478) (amino acid residues 422-427 of the precursor AT3 polypeptide sequence set forth in SEQ ID NO.: 5; and amino acid residues 390-395 of the mature AT3 polypeptide sequence set forth in SEQ ID NO.: 493).

One such mutant, AT3 (AT3/RRVR-KE) (SEQ ID NO.: 497), was made by replacing amino acid residues of the wild-type IAGRSL amino acid sequence with amino acid residues RRVRKE (SEQ ID NO.:498) from a targeted VEGFR2 cleavage sequence. Another mutant, AT3 (AT3/SLGR-KI) (SEQ ID NO.: 499), was made by replacing the wild-type IAGRSL amino acid sequence with amino acid residues SLGRKI (SEQ ID NO.:479) from a targeted complement C2 protein cleavage sequence.

For the Quikchange® PCR, the Wild-type AT3 RCL primer had the following sequence of nucleic acids, which is set forth in SEQ ID NO: 630: GCTGCAAGTACCGCTGTTGTGATTGCTGGCCGTTCGCTAAACCCCAACAG GGTGACTTTC. The Complement C2 target sequence primer had the following sequence of nucleic acids, which is set forth in SEQ ID NO.: 632: GCTGCAAGTACCGCTGTTGTGTCGTTAGGCCGTAAAATTAACCCCAACAGGGTGA CTTTC. The VEGFR2Target sequence primer had the following sequence of nucleic acids, which is set forth in SEQ ID NO.: 634: GCTGCAAGTACCGCTGTTGTGCGCCGTGTGCGCAAAGAAAACCCCAACAG GGTGACTTTC.

Vectors containing the wild-type AT3 cDNA and vectors containing the mutant AT3 cDNA were each transformed and amplified in XL-1-Blue supercompetent cells (Stratagene). Plasmid DNA was purified from the cells using the Qiagen Plasmid Maxi Kit (Qiagen) following the conditions specified by the supplier.

B. Expression Of At3 Mutants

Sf9 insect cells were used to express and purify both His-tagged and FLAG-tagged wild-type and mutant AT3 proteins using the AT3-containing pAcGP67b transfer vectors described above. Sf9 cells were adapted for growth in SF900 II serum-free medium (Invitrogen) and grown to 85-90% confluence in 35 mm dishes. Cells were transfected using the FlashBac® baculovirus expression system (Oxford Expression Technologies) following the conditions and protocol specified by the supplier. 500 ng of the AT3 transfer vector and 500 ng of the FlashBac® recombination vector were pre-incubated for 20 min with 5 μl of Cellfectin® transfection reagent (Invitrogen) in 1 ml SF900 II serum-free media without antibiotics, then applied drop-wise to cells. Five (5) hours after transfection, cells were centrifuged and resuspended in 2 mL SF900 II serum-free medium with antibiotics (antibiotic/antimycotic solution; Cellgro) and were incubated at 28° C. for 4 days. Virus was expanded in Sf9 cells to a maximum titer of $1\times10^6$ pfu/mL, as determined by plaque assay. Recombinant AT3 then was expressed using the High Five® (BTI-TN5B1-4) insect cell line (Invitrogen) and Excell™ 405 serum-free media (JRH Biosciences). Cells were infected at a multiplicity of infection (MOI) between 0.1 and 1 and grown in 300 mL culture volumes in 1 L Erlenmeyer flasks for 4-5 days, shaking at 125 RPM on an orbital shaking platform.

C. Affinity-Based Purification Of Wild-Type And Mutant At3 Proteins

For affinity-based purification of His-tagged AT3 proteins, supernatants from the cultures from Example 7B were cleared by centrifugation and filtration using a 0.45 μM filter and dialyzed into a buffer containing 50 mM Sodium Phosphate pH 7.5, 300 mM NaCl. Protein was purified by column chromatography using the BioLogic Duoflow™ chromatography apparatus (Bio-Rad) and 10 mL of TALON® cobalt metal affinity resin (Clontech). The resin-bound His-tagged protein was eluted with a linear gradient of 50 mM Sodium Phosphate pH 7.5, 300 mM NaCl and 50 mM Sodium Phosphate pH 6.5, 300 mM NaCl, 150 mM Imidazole. Fractions containing protein were combined and dialyzed into AT3 storage buffer (50 mM Sodium Phosphate pH 6.5, 300 mM NaCl, 5% glycerol). To demonstrate that the purified AT3 preparation contained active protein, an MT-SP 1 inhibition (active site titration) assay, as described herein, in Example 14 below, was performed in order to measure the ability of the dialyzed AT3 to inhibit the ability of MT-SP1 to cleave a substrate. The reaction mixture from this MT-SP1 inhibition assay was assessed kinetically for cleavage of 0.4 mM Ac-RQAR-ACC (Acetyl-Arg-Gln-Ala-Arg-ACC) substrate (custom synthesis) on a SpectraMax® M5 (SpectraMax® M5 Microplate Reader, Molecular Devices) (Molecular Devices, Inc). The "ACC" in the name of this substrate refers to the 7-amino-4-carbamoylmethylcoumarin leaving group. The ACC leaving group was detected at wavelengths of Excitation (Ex)=380, Emission (Em)=450 and cutoff (c/o)=435. Total yield of purified His-tagged AT3 protein was approximately 1-3 mg/L.

For affinity-based purification of FLAG-tagged AT3 proteins, supernatants from the cultures were cleared by centrifugation and filtration as described above. Cleared supernatant was dialyzed into Tris-buffered Saline (TBS) pH 7.4 and added to a fresh 1 L Erlenmeyer flask in a total volume of 300 mL. 2 mL of pre-equilibrated anti-FLAG M2 affinity gel (Sigma) was added, and the total volume was incubated on an orbital shaking platform at 125 RPM for 3 hours at 4° C. Resin-bound FLAG-tagged AT3 protein was collected by gravity using a fritted 20 mL chromatography column (Bio-Rad). The resin was washed a first time with 5 mL of TBS, once with 5 mL of TBST (TBS with 0.1% Tween-20), and a second time with 5 mL of TBS. The AT3 protein then was eluted by adding 10 mL TBS containing 0.2 mg/mL FLAG peptide (Sigma). Eluate was concentrated and dialyzed into AT3 storage buffer (50 mM Sodium Phosphate pH 6.5, 300 mM NaCl, 5% glycerol) and activity was assayed as above, using a matriptase (MT-SP1) inhibition (active site titration) assay as described above and in Example 14A below. Total yield of purified FLAG-tagged AT3 protein was approximately 0.5-1 mg/L.

These purified FLAG- and His-tagged AT3 proteins were used as protease traps for identification of proteases recognizing particular target site sequences, for example, in the methods described in the following Examples.

Example 8

Construction of Phage-Display Libraries of Protease Variants

A. Clonig of Wild-type and C122S MT-SP1 Protease Domain (B-chain) into the pMal-C2 Phagemid Display Vector cDNA (SEQ ID NO.: 504) encoding a mature MT-SP1 protease domain (MT-SP1 B-chain) (SEQ ID NO.: 505), which contains amino acids 615-854 of the full-length MT-SP1 protein set forth in SEQ ID NO.: 253, was cloned, using the restrictions sites Nde1 and HindIII, into a pMal-C2 vector (SEQ ID NO.: 615) (New England Biolabs), which-contains an STII leader sequence (TGAAAAAGAATATCG-CATTTCTTCTTGCATCTATGTTCGTTTTTTCTATTG CTACAAACGCGTATGCA (SEQ ID NO.: 636) to facilitate secretion, and nucleic acids encoding a C-terminal domain of filamentous phage M13 GeneIII (SEQ ID NO.:616). The MT-SP1 protease domain cDNA was inserted between the leader sequence and the GeneIII domain so that the final construct contained the sequence of nucleic acids set forth in SEQ ID NO.: 510, which encodes an MT-SP1 N-terminal GeneIII fusion protein. The encoded amino acid sequence (SEQ ID NO.: 506) of this fusion protein is set forth below, with the STII leader sequence (SEQ ID NO.: 511) in plain text, the mature MT-S P1 domain in bold and the C-terminal GeneIII (SEQ ID NO.: 512) domain in italics. The * indicates the presence of a stop codon in the nucleic acid sequence encoding the protein.

```
SEQ ID NO.: 506:
mkkniaflasmfvfsiatnayavvggtdadegewpwqvslhalgqghic gaslispnwlvsaahcyiddrgfrysdptqwtaflglhdqsqrsapgvqe rrlkriishpffndftfdydiallelekpaeyssmvrpiclpdashvfpa gkaiwvtgwghtqyggtgalilqkgeirvinqttcenllpqqitprmmcv gflsggvdscqgdsggplssveadgrifqagvvswgdgcaqrnkpgvytr lplfrdwikentgvsgssgggsegggseegggsegggsgggsgsgdfdyek manankgamtenadenalqsdakgkldsvatdygaaidgfigdvsglang ngatgdfagsnsqmaqvgdgdnsplmnnfrqylpslpqsvecrpfvfsag kpyefsidcdkinlfrgvfafllyvatfmyvfstfanilrnkes*
```

In addition to the wild-type MT-SP1 B-chain fusion protein, an MT-SP1 B-chain variant (CB469)-GeneIII fusion protein was generated using the method described above. The CB469 variant amino acid sequence, set forth in SEQ ID NO.: 507, was generated by substituting a serine for the cysteine at position 122 (based on chymotrypsin numbering) of the wild-type MT-SP 1 protease domain sequence, which is shown in the sequence above in italics and set forth in SEQ ID NO.: 505. This CB469 sequence was cloned into the pMal-C2 vector as described above. In order to achieve improved display, the phagemid vector containing nucleic acids encoding this variant MT-SP 1 fusion protein was used to generate MT-SP 1 mutant phage display libraries as described in Example 8B below.

B. Mutagenesis of Protease Domains for the Generation of Mutant Phage Display Libraries Generation of phage display libraries containing mutated protease domains was done using standard error-prone PCR mutagenesis protocols that are known in the art (Matsumura et al., Methods Mol. Biol. 2002; 182:259-67; Cirino et al., Methods Mol. Biol. 2003; 231:3-9) as exemplified below.

1. Mutagenesis of B-chain MT-SP1 Fusion Proteins

For the construction of mutant MT-SP1-containing fusion proteins, the MT-SP1 CB469 cDNA was amplified from the pMal-C2 vector by error-prone PCR using the Diversify® PCR Random Mutagenesis Kit (BD Biosciences, Clonetech) and following conditions suggested by the supplier to obtain five (5) mutations per kilobase. The MT-SP1 forward primer used in this PCR, having the sequence of nucleic acids set forth in SEQ ID NO.:508): GCGCAGATATCGTACCG-CATATGAAAAAGAATATCGCATTTCTT, was designed to hybridize within the STII leader sequence (with the residues shown in italics) and contained a Nde restriction site sequence (shown in bold). The MT-SP1 reverse Primer, having the sequence of nucleic acids set forth in SEQ ID NO.:509: GTGCATGCTGACTGACTGAGCTCCCGCT-TACCCCAGTGTTCTC, was designed to hybridize within the 3' portion of the sequence encoding the MT-SP 1 protease domain (with the residues shown in italics) and contained a Sac 1 restriction site sequence (shown in bold).

2. Purification of Mutagenesis Products

Taq polymerase binds tightly to DNA and thus is not completely removed by the Qiagen PCR purification kit; and its presence may interfere with downstream restriction digests of PCR products (Crowe et al., Nucleic Acids Res. 1991 Jan. 11; 19(1): 184; Wybranietz et al., Biotechniques (1998) 24, 578-580). Thus, to remove Taq polymerase from the amplified wild-type and mutant PCR products from Example 8B(1), prior to their purification, the following were added to the reaction: 5 mM EDTA, 0.5% SDS, 50 ng/µl proteinase K. To eliminate Taq polymerase, the mixture was incubated at 65° C. for 15 minutes.

To ensure that there was no wild-type template remaining (which could potentially interfere with the selection methods described below), the PCR product was purified to remove template DNA. To separate the vector from the PCR product, samples were loaded onto a 1% agarose gel in the presence of 10× Orange G Gel Loading Buffer (New England Biolabs) which does not co-migrate with the PCR product or ladder. The PCR product was excised from the gel using a scalpel. The excised product was purified using either the QIAquick® Gel Extraction Kit protocols (Qiagen) or the Zymoclean™ Gel Extraction Kit (Zymoclean CA, Cat # D4001) following the conditions specified by the supplier.

For the Qiagen Gel Extraction kit, the excised gel fragment was solubilzed in QG Buffer and slowly passed through a Qiagen QG column, each of which has a binding capacity of about 5-10 µg, and does not hold more than 2 mL. A sufficient number of columns was used to accommodate the full volume of starting material. Columns were centrifuged in collector tubes at 14,000 rpm to remove any residual Buffer QG. 0.7 mL Buffer PE was added to each column and samples were incubated for 2-5 minutes. Columns then were centrifuged twice, for an additional 1 minute each, at 13,000 rpm to remove all residual PE buffer. Samples were transferred into a new 1.5 mL microcentrifuge tube, followed by addition of 50 µL H2O and incubation for two minutes. Bound DNA was eluted by centrifugation at 7000 rpm. Typical yield was between 30% and 60% of the starting amount of sample.

For the Zymoclean™ Gel Extraction Kit, either one or more Zymoclean™ Gel Extraction Kit columns (each of which has a 5 µg maximum binding capacity), or one or more columns from the Zymoclean™ DNA Clean & Concentrator™ Kit (each of which has a 25 µg capacity) were used, depending on the amount of starting material. Using this kit, the excised DNA fragment was transferred to a 1.5 ml microcentrifuge tube, followed by addition of three (3) volumes of ADB Buffer™ to each volume of agarose excised from the gel. Samples were incubated at 37-55° C. for 5-10 minutes until the gel slice had completely dissolved. The dissolved agarose solution was transferred to a Zymo-Spin I™ Column in a Collection Tube and centrifuged at least 10,000 rpm for 30-60 seconds. Flow through from the column was discarded. 200 µL Wash Buffer was added to the column and centrifuged at least 10,000 rpm for 30 seconds. Flow-through was discarded and the wash step repeated. 50 µL of water was added directly to the column matrix. The minimum elution volume was 10 µL for the Zymoclean™ Gel Extraction column and 35 mL for the DNA Clean & Concentrator™ column. The column was placed into a 1.5 ml tube and centrifuged at least 10,000 rpm for 30-60 seconds to elute DNA.

After elution using one of these two methods, samples were pooled and DNA concentration was assessed by measuring absorbance of the sample at 260 nm in a 70 µL UV cuvette, using a spectrofluorometer. DNA concentration was calculated according to the following equation: 1A260=50 ng/µl ds DNA.

C. Construction of Protease Mutant Phage Libraries using the pMal-C2 Phagemid Vector For construction of phage display libraries expressing mutant protease domains, digested PCR products, such as those obtained from the protease PCR mutagenesis and purification described in Example 8A and B above, were ligated into the pMal-C2 phagemid vector described above. For this process, the vector was digested using Nde1 and Sac1, and the product gel purified and combined in a ligation reaction (described below) with the purified, restriction-digested PCR products. The molecular weight (MW) of the Nde1/Sac1 digested, gel purified pSTII-g3 pMal-C2 phagemid is 5835 base pairs (bp); the MW of the Nde1/Sac1 digested MT-SP1 PCR product is 806 bp. Typically, for a 2 mL ligation reaction, 7.58 µg cut vector was about 1 nM of vector and 3.14 µg cut MT-SP1 product was about 3 nM insert product.

For ligation of the MT-SP1 products, 40 µl (3 nM, 3.14 µg) of the digested, purified product was mixed with: 40 µl (1 nM, 7.58 µg) of digested, purified vector; 1510 µl H$_2$O; 400 µl 5× T4 DNA Ligase Buffer (Gibco); and 10 µl (10 units) T4 DNA Ligase (New England Biolabs). The ligation reaction was carried out overnight at 16° C. or at room temperature for 4 hours in a 2 mL volume. After ligation, the DNA Ligase was heat-inactivated by incubating the ligation reaction mixture at 65° C. for 15 minutes followed by addition of 4 mL ZymoResearch DNA Binding Buffer. This sample then was added, 800 µl at a time, to a 25 µg ZymoResearch Column. The column was washed twice with 600 µl ZymoResearch Wash Buffer and eluted with 50 µL water, which had been prewarmed to 42° C. Percent DNA recovery was assessed by measuring absorbance of diluted elution sample (3 µl elution in 70 µl H2O) at 260 nm using a spectrofluorometer. For example, for the 3 mL ligation above, if the A260 corresponded to 0.12=140 ng/µl, then the total yield was determined to be about 7 µg (which is about 70% recovery of DNA from the ligation).

The ligation product was electroporated into XL-1 blue cells, which can accommodate approximately 500 ng/µl by electroporation. 7.5 µl of a 140 ng/µl ligation was added per 200 µl XL-1 Blue Cells (Stratagene). The cells were added to a 0.2 cm gap cuvette and electroporated in a Gene Pulsar (Bio-Rad, CA) using the following conditions: Voltage (V)=2500, Capacitance=25 (uF), Resistance=200 ohms. Immediately following electroporation, 1 mL SOC medium (Invitrogen) was added to the cuvette. The cells then were transferred to 25 mL SOC medium and incubated at 37° C. for 20 minutes. Following this incubation five (5) small aliquots (100 microliter) of serial 100-fold dilutions of the cells were made and plated on small 2YT Carbenicillin agar plates and incubated overnight at 37° C. for counting the number of colonies (representative of the number of clones from the library generated by electroporation). In one method, the remaining culture volume was centrifuged to pellet the cells followed by resuspension in 12 mL SOC buffer and plating on large agar plates (245 mm×245 mm) supplemented with Carbenicillin (75 ug/ml) and grown overnight at 30° C. Alternatively, to prepare phage stock from the library, the cells were added directly to 500 mL 2YT medium supplemented with Carbenicillin (75 ug/ml) with M13KO7 helper phage at 1×10$^{10}$ CFU/mL and grown overnight at 37° C.

Example 9

Selection of Variant Protease Domains from Protease Domain Phage Libraries Using Mutant AT3 Protease Traps A. Selection of MT-SP1 Phage/mutant AT3 Complexes and ELISA-based Readout Assay In this example, a mutant AT3 inhibitor containing the complement C2 target cleavage sequence SLGRKI, as described in Example 7 above, was used as the "bait substrate" in a panning experiment designed both to isolate and provide a readout for the presence of mutant MT-SP 1-bearing phages with improved reactivity toward the target cleavage sequence. Phages were isolated from large, combinatorial MT-SP1 phage display libraries produced as described in Examples 8A, 8B and 8C above using the following procedure.

1. Interaction with and Cleavage of AT3 Variants by Mutant MT-SP1-Bearing Phages Phage-bound MT-SP1 mutants from phage libraries were first selected using mutant AT3 having the target cleavage site as follows. Each cleavage reaction was carried out in duplicate wells of a 96-well polystyrene plate (Nunc Maxysorp) for 60 minutes at 37° C., by incubating the following reaction components in a 70 µL volume: 35 µl MT-SP1 library phage at 3.14E$^{12}$ CFU/ml; 7 µL 10×MT-SP1 Activity Buffer (0.5 M Tris-HCl, pH 7.4, 1M, NaCl, 1% Tween20); 7 µL 10 µM Low Molecular Weight Heparin (BD Biosciences); 14 µL H$_2$O; and 7 µL of His-tagged mutant AT3-SLGRKI. Individual cleavage reactions were carried out with the following different AT3-SLGRKI concentrations: 100 nM, 33 nM, 11 nM, 3.3 nM, 1.1 nM and 0.33 M. Each reaction was terminated with the addition of 2 µL 100 mg/ml of the protease inhibitor 4-(2-Aminoethyl)-benzenesulfonyl fluoride (Pefabloc, Roche Diagnostics). 40 µL of a 0.55% BSA, 0.275% Tween 20 solution then was added and mixed thoroughly by pipetting up and down.

2. Capture of MT-SP1 Phage-AT3 Complexes Using Anti-His Antibodies

Meanwhile, wells in another 96-well polystyrene plate (Nunc Maxysorp) were coated for 1 hour with shaking at room temperature with 100 µL of 5 ng/µl Streptavidin (Pierce) in 0.2 M Carbonate Buffer (pH 9, Pierce). The wells then were washed three times with 250 µL PBST, blocked with 200 µL of 0.2% BSA in PBS for 2 hours at room temperature, incubated for 1 hour at room temperature with 100 µl of 5 ng/µl biotinylated Anti-6HIS antibody to capture His-tagged AT3 mutants, and washed thoroughly with PBST. Each mutant MT-SP1 phage sample from the AT3 cleavage reaction in Example 9A(1) then was added in duplicate to the coated 96 well plate and incubated for 1 hour at room temperature. Plates then were washed 14 times with 250 μL PBST.

3. ELISA-Based Readout for Selection of MT-SP1 Phage-AT3 Complexes

After washing, the first of the two rows in the microtiter plate was used to carry out an ELISA (Enzyme-Linked Immunoassay)-based assay to obtain a readout for phage capture. To each well in this row, 100 μL of a 1:5000 dilution of an HRP conjugate anti M13 phage antibody (GE Healthcare) was added and allowed to bind for one hour. The wells in this row then were washed 8 times using a Skanwasher plate washer (Molecular Devices), followed by addition of 100 μL TMB/Peroxide substrate solution (Pierce) and incubation at room temperature for 5 minutes. This reaction was quenched with 100 μL 2M H2SO4 and assayed on a SpectraMax® plate reader (Molecular Devices) for absorbance at 450 nM. This readout was used as a surrogate for the presence of phage-AT3 complexes. In this assay, a concentration-dependent increase in absorbance was observed (based on increasing concentrations of AT3-SLGRKI bait used in the cleavage reaction in Example 9A(1)). Further, when the process was performed using successive rounds of panning as described herein, increased absorbance was observed after each round, indicating that this panning method could successively enrich the phage pool for target cleavage site affinity. These data suggest that this method can be used to select, from a phage library, mutant protease domain fusion proteins having affinity for a particular target sequence. The ELISA assay provided a method for obtaining a readout for this selection and enrichment, using the same 96-well plate that was used for affinity-based capture and subsequent elution described in Example 9A(4) below.

4. Elution of Selected MT-SP1 Phage

The second of the two duplicate rows of the microtiter plate from Example 9A(2) then was used to elute specifically bound phages for use in subsequent purification and screening. To each well in this row, 100 μL 100 mM HCL was added and incubated for 5 minutes to elute the specifically bound phage. The resulting phage eluate was added to a separate well containing 33 μL of 1M Tris pH 8 for acid neutralization prior to infection. The 133 μL of neutralized phage mix then was added to 1 ml of XL-1 Blue cells growing at an OD600 of 0.5, which then were incubated for 20 minutes at 37° C. and plated out onto 2×YT agar plates (245 mm×245 mm) supplemented with Carbenicillin. These cells were used in subsequent screening, sequencing and purification methods as described in the Examples below.

This selection and ELISA-based assay method was also used to select and assess uPA mutants from uPA libraries, such as those described in Examples 2 and 3 above.

B. Purification Of Selected Protease Domain-Bearing Phages

This Example describes a method for isolation of phage supernatants that had been selected using bait inhibitors. Titers (cfu/mL) of selected phages, such as those recovered in Example 9A above, were determined. Phage stocks were diluted with PBS and used to infect *E. coli* XL-1 Blue cells, growing at an OD600 of 0.5 or approximately $2.1 \times 10^8$ cells/mL. The desired infectivity range was 1000-2000 colonies per plate. Infected cells were plated onto 2YT agar supplemented with 100 μg/mL Carbenicillin in square 245 mm×245 mm polystyrene BioAssay (Corning) dishes and allowed to grow for 16-20 hours or until colony size were roughly 2 mm in diameter. Using an automated Colony Picker, individual colonies were picked and dispersed into wells in a 96 well polypropylene plate, each well containing 150-170 uL of 2YT medium supplemented with 100 μg/mL Carbenicillin and 12 μg/mL Tetracycline. Control wells were inoculated with cells infected with either template phage (phage having a protease domain that had been used as the template for mutagenesis) or with phage containing fusion proteins containing inactive protease variants. The inoculated plates were sealed with an air-permeable membrane, placed into a HiGro (GeneMachines) incubator and shaken at 400 rpm at 37° C. for 14-20 hours.

After the incubation, to obtain log-phase cells, 100 μL from each well was used to inoculate a well in a deep well 96 well plate containing 1 mL 2YT medium supplemented with 100 ug/mL Carbenicillin and 12 μg/mL Tetracycline. The deep well plate then was sealed with an air-permeable membrane and placed in the HiGro® incubator with shaking at 400 rpm at 37° C. with oxygen aeration until the cell density reached an OD600 of between 0.4 and 0.6. A typical incubation period was between 4 and 5 hours. After incubation, 100 μL of a helper phage stock was added to each well and the plate sealed and shaken again at 400 rpm for 5-10 minutes at 37° C. After the 5-10 minutes of shaking, the plate was incubated at 37° C. in a static state without shaking for 30-45 minutes. Shaking then was resumed at 400 rpm for 15-30 minutes at 37° C. Following shaking, 100 μL kanamycin solution (400 μg/mL) was added to each well to yield a final concentration of 33.3 μg/mL in each well. The plate was resealed, and shaken at 400 rpm at 37° C. for 12-16 hours. To pellet the cells, the plate then was centrifuged at 3500-4500 rpm for 20 minutes at 4° C. After centrifugation, supernatants, which contained isolated phage, were either used immediately for screening as described in the Examples below, or first were stored at 4° C.

C. Polyethylene Glycol (peg) Precipitation of Protease Domain Phage Supernatants This Example describes a method for removing potentially contaminating background protease activity (to which some characterization assays described herein below are sensitive) in purified selected phage supernatants using Polyethylene Glycol precipitation. In this method, after rescuing the MT-SP1-bearing phage supernatants (such as those selected and eluted in Example 9A) overnight (12-16 hours) with helper phage samples were centrifuged for 20 minutes at 4° C. at 3500-4500 rpm and 1000 μL of supernatant was removed from each well and transferred to a well in another 96 well deep well plate.

For precipitation, 250 μL of a solution containing 20% PEG (by volume) in 2.5M NaCl was added to each well. The plate was sealed and mixed by vigorous inversion, and then placed in an ice-water bath and left static for 1-2 hours. The plate then was centrifuged for 60 minutes at 4500 rpm or for 90 minutes at 3500 rpm. The supernatant solution from each well was decanted out and the plate was patted dry and allowed to drain for 20-30 minutes. The resultant precipitate was resuspended using PBS at a final volume equivalent to 20% of the original phage supernatant volume (200 uL) to yield a 5-fold concentrate. This material either was used immediately in assays described below, or stored at 4° C. until ready for testing.

Example 10

Screening of Protease Domain-Bearing Phages Having Increased Reactivity and Catalytic Efficiency Towards Target Substrate Sequences Individual phage preparations, such as those described in Example 9B and 9C, were used in various assays to determine their specificity and/or activity.

A. Analysis of Phages Expressing Protease Domain Variants by Monitoring Inhibition of Fluorogenic Peptide Hydrolysis by Bait Proteins As one approach for assessing mutant protease-bearing phage clones, a biochemical inhibition assay can be performed comparing the ability of an inhibitor (bait serpin) to inhibit the activity of the selected variant protease domain with its ability to inhibit the activity of the template protease domain (i.e., the "parental" protease) that was originally used in phagemid library construction. With this approach, the ability of mutant protease-bearing phages, such as those recovered in Example 9 above, to cleave a fluorogenic substrate containing a target substrate sequence is assessed in the presence and in the absence of a given concentration of inhibitor bait, and compared to the ability of the template protease domain to cleave the same sequence in the presence of the same bait. The use of fluorogenic peptide substrates is a routine method for the determination of protease specificity (Zimmerman et al. (1977) Anal Biochem, 78:47-51; Harris et al. (2000) PNAS, 97:7754-7759).

For analysis of inhibition of MT-SP1 B-chain mutants compared to inhibition of MT-SP1 B-chain template (used for mutation in Example 8B(1)), the variant AT3 (with a desired target sequence) can be used as the inhibitor and Ac-RQAR-ACC can be used as the substrate. In this substrate, specific cleavage of the anilide bond frees the fluorescent ACC leaving group, providing an efficient means to determine the cleavage rates for individual substrates.

In one example of such an assay, the ability of uPA protease-bearing phages, such as those recovered in Example 3 above, to cleave the fluorogenic substrate Ac-AGR-AMC (SEQ ID NO.: 617) was assessed in the presence and in the absence of a given concentration of PAI bait. As described above, the use of such a 7-amino-4-methylcoumarin (AMC) fluorogenic peptide substrate is a routine method for the determination of protease specificity. In this example, 35 µL of phage supernatant (such as that obtained as described in Example 3(A)) was transferred to both a designated assay well and a designated control well in a 384-well Polypropylene plate (CoStar, #3658). 35 µL of 2× Indirect Assay Buffer containing the same PAI bait used in the selection was added to the assay wells. The concentration of bait was the same as used in the selection. 35 µL of 2× Indirect Assay Buffer (without inhibitor) was added to the corresponding control wells. The plates were incubated at 37° C. for 60 minutes. Following the mixing of the phage with inhibitor or control buffer, 10 µL of an AGR-AMC fluorogenic peptide substrate, diluted to a final assay concentration of 60 µM in Indirect Assay Buffer, was added the wells. Fluorescence was measured using a Molecular Devices SpectraMax® Plate Reader with Excitation at 380 nm, Emission set at 460 nm, using the kinetic read mode for one hour. Clones showing enhanced inhibition of the target substrate with respect to the template protease were further analyzed.

B. Analysis Of Variant Protease Activity Using Fluorogenic Peptide Substrates To directly assess the activity and specificity of MT-SP1 mutants, an assay was performed using the fluorogenic peptide substrates Ac-RQAR-ACC (having the native autocatalytic cleavage sequence recognized by wild-type MT-SP1) and Ac-SLGR-ACC (Acetyl-Ser-Leu-Gly-Arg-ACC) having the C2 target site cleavage sequence). As noted above, the ACC in the names of these substrates represents 7-amino-4-carbamoylmethylcoumarin, which is the fluorescent leaving group. Also as noted above, the use of fluorogenic peptide substrates is a routine method for the determination of protease specificity (Zimmerman et al. (1977) Anal Biochem, 78:47-51; Harris et al. (2000) PNAS, 97:7754-7759). In this example, specific cleavage of the anilide bond frees the fluorescent ACC leaving group, providing an efficient means to determine the cleavage rates for individual substrates. In this method, 35 µL of 2× Indirect Assay Buffer was added to all test wells. 35 µL of phage supernatant (isolated as described in Example 9B) or re-suspended PEG precipitated phage (isolated as described in Example 9C) was added to each of the designated wells. After addition of the phage, the plate was centrifuged at 2000 rpm for 1 minute to remove air bubbles. 10 µL of each of the Peptide Substrates (Ac-SLGR-ACC (final assay concentration=125 µM)) and Ac-RQAR-ACC (final assay concentration=60 uM)) was diluted with 1× Indirect Assay Buffer and then added individually to appropriate wells. The rate of hydrolysis (ROH), measured as Relative Fluorescence Units/second (RFU/s)); indicative of substrate cleavage, was monitored over time using a SpectraMax® M5 Microplate Reader (Molecular Devices), using the kinetic read mode.

Example 11

Production, Selection, Assessment and Identification of MT-SP1 Mutants

A. Fluorogenic Assay Of B-Chain MT-SP1 Mutants From Phagemid Library

This example describes a fluorogenic assay that was carried out to analyze the activity and specificity of MT-SP1 protease domain-bearing phages produced using library produced as described in Example 8. The MT-SP1 library was prepared as described in Example 8 above, using the native B-chain of MT-SP 1 that has a serine in place of the cysteine at position 122 based on chymotrypsin numbering (SEQ ID NO.: 507) as a template. The library was prepared as described above, using the pMal-C2 vector and error-prone PCR conditions recommended by the supplier to achieve an approximate mutagenesis rate of 0.5%. The yield from this mutagenesis reaction was $4 \times 10^9$ recombinants.

Selection of phages based on the rate of interaction with and cleavage of the variant AT3 containing the target substrate sequence (in place of the native RCL; as described in Example 7) was carried out as described in Example 9A using a polypropylene 96 well format. For this selection, $1 \times 10^{12}$ recombinant phages were mixed with 3.3 nM variant AT3 carrying an SLGRKI RCL sequence for 30 minutes. After washing, phage were eluted as described in Example 9A above, and used to infect XL-1 blue cells as described in example 9B.

Successive rounds of selection were performed to enrich for rapid interaction with and cleavage of the target substrate sequence using methods provided and described herein. For example, clones selected in the first round were subjected to a second round of selections as described herein, using 3.3, 1.1, and 0.33 nM AT3 for one hour as described in Example 9A(3).

Following the first round of selection, phage supernatant was prepared as in Example 9C using PEG precipitation from selected clones. Phage clones were screened using the method of Example 10(B) above, using, as fluorogenic substrates, both Ac-SLGR-ACC (containing C2 target cleavage site sequence) and Ac-RQAR-ACC (containing the native cleavage sequence for the native MT-SP 1). For each clone, the rate of fluorescence (ROF) determined from the Ac-SLGR-ACC assay was compared to the ROF determined from the Ac-RQAR-ACC assay as a means to compare the activity of each mutated MT-SP1 protease domain on the native substrate sequence to its activity on the target substrate sequences. The ROFs in the mutant MT-SP1 assays also were compared to the ROFs in the template (C122S) MT-SP1 assay. The results obtained with individual clones are shown in Table 21 below, which lists clone numbers, and lists the rate of fluorescence as RFU/s (relative fluorescence units per second).

TABLE 21

Screening of mutant MT-SP1 protease domain-bearing phage selected for cleavage rate of AT3-SLGRKI

| Mutant MT-SP1 Clone Number | Ac-SLGR-ACC Rate (RFU/sec.) | Ac-RQAR-ACC Rate (RFU/sec.) |
| --- | --- | --- |
| Template | 1.85 | 15.6 |
| CPC-0019595 | 7.1 | 33 |
| CPC-0023085 | 0.8 | 2 |
| CPC-0023230 | 1.3 | 4 |
| CPC-0023401 | 3.9 | 12 |
| CPC-0023949 | 0.7 | 2 |
| CPC-0024129 | 3.8 | 15 |
| CPC-0024153 | 2.5 | 6 |
| CPC-0024527 | 4.3 | 12 |
| CPC-0024715 | 3.2 | 12 |
| CPC-0025366 | 1.3 | 1 |
| CPC-0025387 | 6.8 | 14 |
| CPC-0025533 | 6.9 | 23 |
| CPC-0025582 | 1.7 | 3 |
| CPC-0025720 | 2.5 | 5 |
| CPC-0025866 | 1.2 | 4 |
| CPC-0025876 | 4.0 | 8 |
| CPC-0025890 | 10.6 | 33 |
| CPC-0025941 | 1.0 | .4 |
| CPC-0025974 | 9.3 | 41 |
| CPC-0026100 | 14.8 | 25 |
| CPC-0026122 | 6.5 | 31 |
| CPC-0026125 | 17.4 | 84 |
| CPC-0026200 | 7.0 | 21 |
| CPC-0026219 | 8.0 | 23 |
| CPC-0026232 | 7.1 | 15 |
| CPC-0026597 | 11.0 | 34 |
| CPC-0026727 | 0.8 | 2 |
| CPC-0026761 | 7.8 | 25 |
| CPC-0027290 | 3.9 | 12 |
| CPC-0027306 | 11.0 | 50 |
| CPC-0027309 | 8.3 | 50 |
| CPC-0027326 | 9.1 | 54 |
| CPC-0027335 | 12.3 | 57 |
| CPC-0027369 | 2.3 | 11 |
| CPC-0027399 | 13.4 | 99 |

TABLE 21-continued

Screening of mutant MT-SP1 protease domain-bearing phage selected for cleavage rate of AT3-SLGRKI

| Mutant MT-SP1 Clone Number | Ac-SLGR-ACC Rate (RFU/sec.) | Ac-RQAR-ACC Rate (RFU/sec.) |
| --- | --- | --- |
| CPC-0027484 | 2.5 | 12 |
| CPC-0027516 | 3.4 | 17 |
| CPC-0027617 | 1.4 | 7 |
| CPC-0027706 | 0.4 | 1 |
| CPC-0027718 | 2.1 | 7 |
| CPC-0027797 | 5.5 | 15 |
| CPC-0027841 | 2.7 | 9 |
| CPC-0028017 | 5.1 | 16 |
| CPC-0028333 | 5.6 | 17 |
| CPC-0028341 | 5.5 | 26 |

B. Identification Of Selected MT-SP1 Mutant Phages By DNA Sequencing

This Example describes a method used for identification of positive phage clones that were prepared as described in the previous Examples and selected based on results from a fluorogenic assay, such as the one described in Example 10B above. For this method, individual clones were mixed with XL-1Blue E. coli cells for infection and the cultures grown overnight shaking at 37° C. Plasmid DNA was purified from the overnight culture using a plasmid preparation kit (Qiagen), and the DNA sent out for sequencing for identification of the mutants.

In one example of this method, the amino acid sequences of selected B-chain MT-SP1 mutants from Example 11A above were identified using the steps outlined above. The sequencing primer that was used for identification of these clones is set forth in SEQ ID NO.: 618: 5'GGTGTTTTCACGAGCACTTC3'. The results obtained by analyzing the sequencing data are set forth in Table 22 below. This table lists only mutants with residues found to be mutated in more than one isolate. Table 22 lists the amino acid mutations/positions for each clone compared with the wild-type MT-SP1 B-chain sequence (SEQ ID NO.: 505), which were determined by analysis of sequencing data. Amino acid numbering is according to chymotrypsin numbering. SEQ ID NOs. also are listed for both the sequence of amino acid residues that encodes the MT-SP1 protease domains (B-chains) containing the indicated amino acid mutations and also for the sequence of amino acid residues that encodes the full-length MT-SP1 protein having the same mutations.

TABLE 22

Selected MT-SP1-mutants

| Mutant MT-SP1 Clone Number | Amino Acid Mutation (Chymotrypsin Numbering) | SEQ ID NO (protease domain).: | SEQ ID NO (full-length).: |
| --- | --- | --- | --- |
| CPC-0019595 | C122S/I136T/N164D/T166A/F184(A)L/D217V | 516 | 537 |
| CPC-0023085 | I41F/C122S | 517 | 538 |
| CPC-0024153 | I41F/C122S/A126T/V244G | 518 | 539 |
| CPC-0025366 | D23E/I41F/T98P/C122S/T144I | 519 | 540 |
| CPC-0025387 | I41F/C122S | 520 | 541 |
| CPC-0025582 | I41F/C122S/L171F/V244G | 512 | 542 |
| CPC-0025720 | C122S/H143R/Q175R | 522 | 543 |
| CPC-0025876 | I41F/C122S/L171F | 523 | 544 |
| CPC-0025974 | C122S/R230W | 524 | 545 |
| CPC-0026100 | I41F/C122S/I154V/V244G | 525 | 546 |
| CPC-0026232 | I41F/L52M/C122S/V129D/Q221(A)L | 526 | 547 |
| CPC-0027399 | F99L/C122S | 527 | 548 |
| CPC-0027706 | F97Y/C122S/I136V/Q192H/S201I | 528 | 549 |
| CPC-0027797 | H71R/C122S/P131S/D217V | 529 | 550 |

TABLE 22-continued

Selected MT-SP1-mutants

| Mutant MT-SP1 Clone Number | Amino Acid Mutation (Chymotrypsin Numbering) | SEQ ID NO (protease domain).: | SEQ ID NO (full-length).: |
|---|---|---|---|
| CPC-0028017 | C122S/D217V | 530 | 551 |
| CPC-0028333 | T65K/F93L/F97Y/C122S/D217V | 531 | 552 |

Example 12

Preparation and Characterization of Large Quantities of Selected Phage-Bound MT-SP1 Protease A. Large-Scale Preparation of MT-SP1 Phage This Example describes preparation of larger quantities of selected MT-SP1 protease domain-bearing phages for analysis and subsequent use of selected protease domains in downstream methods, such as in vitro translation in whole MT-SP1 proteases. For this Example, single phage-bearing colonies, selected as in Example 11 above, were grown overnight in 2YT medium supplemented with Carbenicillin, at a final concentration of 50 μg/mL, and tetracycline, at a final concentration of 12 μg/mL, in small sterile Corning Orange Capped Erlenmeyer Flasks overnight. To make glycerol stocks, 85 μL 60% glycerol was added to 500 μl of each culture followed by storage at −80° C. The remaining volume of each culture was added to a 2 L widemouth baffled flask containing 500 ml 2YT medium supplemented with Carbenicillin and Tetracycline. Alternatively, this step was performed in a 500 mL flask in a 50 mL volume. The culture was grown until an OD600 of 0.5 was reached.

M13KO7 Helper Phage was added to the culture to yield $1E^{10}$ CFU/ml and the culture incubated for 1 hour at 37° C. Kanamycin was added to a final concentration of 30 μg/mL. The cultures with helper phage were rescued overnight by incubation at 37° C. Following overnight culture, samples were centrifuged at 6000 rpm for 15 minutes. One volume PEG/NaCl (20% PEG 8K/1.5 M NaCl) solution was added per 5 volumes of culture. The sample then was stirred at 4° C. for 20 minutes. Samples were centrifuged at 10,000 rpm for 20 minutes and supernatants removed. After a second centrifugation step at 10,000 rpm, the pellet was resuspended in 5 mL (for the initial 500 mL volume) or 1 mL (for the initial 50 mL volume) PBS. Precipitated cells that were not resuspended were removed by brief centrifugation at 14,000 rpm for 2 minutes. Glycerol was added, at 10% by volume, to the supernatant containing the resuspended cells. The cells were frozen at −80° C.

B. Assay Of Prepared Phage Using Acc And Qf Substrates

This Example describes a fluorogenic assay used to assess activity and specificity of the phages prepared in Example 12A. PEG-precipitated mutant MT-SP1-bearing phage clones, prepared using the 50 mL volume culture as described in Example 12A, were normalized to $1E^{13}$ particles/ml. The phage were then assayed enzymatically using the ACC fluorogenic and QF (Quenched Fluorescence) substrates as follows. 5 μL phage (at $1E^{13}$ particles/ml) was added to each well in a black Costar polypropylene half-well microtiter plate (Corning) along with 5 μL 10×MT-SP1 assay buffer, 35 μL $H_2O$ and 5 μL substrate in a total volume of 50 μL. The substrates used in individual wells were: Ac-SLGR-ACC (120 uM final concentration), Ac-RQAR-ACC (60 uM final concentration), or the following quenched-fluorescence substrates: SLGR-KI, and RQAR-SA (both used at 0.625 uM final concentration). The Ac-SLGR-ACC substrate was used to assess cleavage, by the mutant MT-SP1 clones, of the target (complement C2) cleavage sequence, while the Ac-RQAR-ACC substrate was used to assess cleavage of the native target cleavage sequence for MT-SP1. Likewise, the SLGR-KI substrate was used to assess cleavage of the target (complement C2) cleavage sequence, while the RQAR-SA substrate was used to assess cleavage of the native target cleavage sequence for MT-SP1. The ratio of these two cleavage rates was one quantitative measure of the specificity of the selected proteases for the targeted, new cleavage sequence. Comparison of these ratios for a selected variant and the corresponding original scaffold (i.e., parental) protease indicated whether the selected protease exhibited enhanced selectivity towards the targeted, new cleavage sequence. For the ACC Readout, the SpectraMax® plate reader was set for excitation at 380 nM and to detect emission at 460 nM, with a 435 nM cutoff. For the QF readout, the SpectraMax® plate reader was set for excitation at 490 nM, to detect emission at 520 nM, with a cutoff of 515 nM. The results of this assay are set forth in Table 23 below. As above, SEQ ID NOs. are listed for both the sequence of amino acid residues that encodes the MT-SP1 protease domains (B-chains) containing the indicated amino acid mutations and also for the sequence of amino acid residues that encodes the full-length MT-SP1 protein having the same mutations, as determined by sequencing, as described in Example 11B above. RFU (relative fluorescence units) numbers correspond to the rate of hydrolysis observed in a 60 minute reaction at 37° C. for each substrate.

TABLE 23

Kinetic assay of selected MT-SP1 protease domain-bearing phage clones

| Mutant MT-SP1 Clone Number | Amino Acid Mutation (Chymotrypsin Numbering) | SEQ ID NO. (protease domain): | SEQ ID NO. (full-length): | Ac-SLGR-ACC (RFU/s) | Ac-RQAR-ACC (RFU/s) | SLGR-KI (RFU/s) | RQAR-SA (RFU/s) |
|---|---|---|---|---|---|---|---|
| Template | C122S | 507 | 515 | 2.4 | 23.5 | 0.12 | 0.11 |
| CPC-0028341 | I41T/C122S/P173S/Q209L | 531 | 553 | 10.9 | 56.8 | 0.36 | 0.48 |

TABLE 23-continued

Kinetic assay of selected MT-SP1 protease domain-bearing phage clones

| Mutant MT-SP1 Clone Number | Amino Acid Mutation (Chymotrypsin Numbering) | SEQ ID NO. (protease domain): | SEQ ID NO. (full-length): | Ac-SLGR-ACC (RFU/s) | Ac-RQAR-ACC (RFU/s) | SLGR-KI (RFU/s) | RQAR-SA (RFU/s) |
|---|---|---|---|---|---|---|---|
| CPC-0033634 | F97L/C122S/F234L | 533 | 554 | 6.2 | 37.2 | 0.21 | 0.19 |
| CPC-0028971 | C122S/Q175R | 534 | 555 | 3.4 | 11.0 | 0.20 | 0.18 |
| CPC-0027484 | N95K/C122S | 535 | 556 | 2.0 | 9.5 | 0.07 | 0.05 |
| CPC-0028993 | Y60(G)S/C122S | 536 | 557 | 0.5 | 1.0 | 0.02 | 0.01 |

*RFU/s = Relative fluorescence units/second (Rate of hydrolysis)

Example 13

Expression of Selected MT-SP1 Mutant Proteins Using In Vitro Translation

This example describes the expression of MT-SP1 protease domains selected and screened as in the Examples described above, that are not part of a gene III fusion protein.

A. Subcloning of MT-SP1 Sequence Into A Modified IVEX Vector

In order to express MT-SP1 protease domains selected on phage, as described in the Examples above, that are not synthesized as gene III fusion proteins, the coding region for the MT-SP1 protease domain containing the N-terminal activation sequence and a C-terminal 6×His tag was cloned into the pIVEX.2.3d RTS in vitro translation vector (Roche; SEQ ID NO.: 559)) using the NdeI and XhoI restriction sites. The full N-terminal amino acid sequence of the pIVEX.2.3d.MT-SP1 preceding the RQAR cleavage site is set forth in SEQ ID NO.: 558: MEKTRHHHHHHSGSDCGLRSFTRQAR. Residues encoding MT-SP1 B-chain proteins, which had been selected using phagemid libraries as described above, assayed using fluorogenic screening methods as described in Example 10B and 11A, and sequenced as described in Example 11B, were subcloned into the pIVEX.2.3d.MT-SP1 vector using the internal SphI and BsrGI restriction sites. Phagemid selectants having mutations in the MT-SP1 sequence that were outside these internal sites were created for use in this method by PCR mutagenesis.

B. Expression of MT-SP1 by in VITRO Translation

Expression of MT-SP1 protease domains using an in vitro translation kit, the RTS 100 *E. coli* Disulfide kit (Roche Applied Science), was performed using conditions specified by the supplier with the following optimizations: The components of the 50 µl reaction solution were modified to include 12 µl of amino acid mix, 10 µl of reaction mix, 12 µL of lysate, along with the addition of 5 µl of 1 M Hepes pH 8 buffer, 2.5 µl 12 nM Tween-20, 2.5 µl of Protein Disulfide Isomerase (PDI), and 6 µl of the chaperone RTS GroE Supplement (Roche Applied Science). The 1 mL Feeding mix was also modified to include 168 µl of amino acid mix, 24 µl of methionine, 608 µl of feeding mix, 100 µl of 1 M Hepes pH 8, 50 µl of 12 nM Tween-20, and 50 µl of water. The in vitro translation (IVT) reaction was incubated on a plate shaker at 30° C. for 18 hours.

C. Purification of His-Tagged MT-SP1

Following the in vitro translation (IVT) reaction, insoluble protein was cleared by centrifugation and transferred to a fresh tube. The cleared supernatant (with a volume approximately 45 µl) was brought up to a final volume of 1 mL in 50 mM Sodium Phosphate pH 7.5, 300 mM NaCl. The solution was applied to 300 µl of pre-equilibrated TALON® resin in a 2 mL fritted chromatography column (Clontech) and allowed to flow through by gravity. The column was washed with 3 mL of a solution containing 50 mM Sodium Phosphate pH 7, 300 mM NaCl and 7.5 mM Imidazole; and eluted with 600 µl of a solution containing 50 mM Sodium Phosphate pH 6.5, 300 mM NaCl and 75 mM Imidazole. Eluate was dialyzed into phosphate-buffered saline with 0.1% Tween-20 (PBST) and concentrated to 20 µL. Typically, the yield of purified protease was approximately 70%.

Example 14

Characterization of Mutated MT-SP1 Protease Domains

This Example describes the characterization of the mutated mutant MT-SP1 protease domains that were produced as in Example 13 above.

A. Active Site Titration Of IVT Reactions

To assess protease activity, active site titration of in vitro-translated mutant MT-SP1 protease domains was performed on cleared supernatant with the MT-SP1 inhibitor M84R Ecotin, as described (Takeuchi et al, (1999) PNAS 96,11054-11061). For this assay, IVT protein was diluted to a final concentration of 1:10,000 in 1×MT-SP1 activity buffer and incubated with 15 nM Ecotin in 1:2.5 serial dilutions for 1 hour at 30° C. The reaction was assessed kinetically for cleavage of 0.4 mM Ac-RQAR-ACC substrate on a SpectraMax® M5 Microplate Reader (Molecular Devices, Inc). The ACC leaving group was detected at wavelengths of Excitation (Ex)= 380, Emission (Em)=450 and cutoff (c/o)=435. The assay points showing fractional activity between 20% and 80% uninhibited activity was plotted on a graph of activity vs. Ecotin concentration, and a line plotted though the points. The x-intercept of the line was used to establish the active concentration of the IVT protease. The reaction was graphed, with the linear part of the curve representing the active concentration of the IVT protease. Thus, the active site concentration (set forth for several mutants in Table 24 below; Active Site Conc.) was determined using Active Site Titration.

B. Assay OF IVT MT-SP1 Protease Domain Mutants with ACC and QF Substrates

Several IVT-produced MT-SP1 phage selectants were assessed for increased specificity for the mutant RCL cleavage site over the native RQAR MT-SP1 cleavage site by quenched fluorescence (QF) kinetic enzyme assays. IVT supernatants, cleared as described in Example 13C above, were diluted 1:10,000 in 1×MT-SP1 activity buffer and incubated with 6.25 µM of either the native RQAR-SL QF substrate or the mutant RCL C2 cleavage substrate, SLGR-KI. Cleavage was assessed using a SpectraMax® M5 Microplate Reader (Molecular Devices) with wavelengths of Ex=490, Em=520 and c/o=515. The relative specificity of the IVT-produced protease for the RCL target sequence over the native sequence was calculated using the ratio of the RFU/s (Relative fluorescent units per second) for SLGR-KI and RQAR-SL. The results are set forth in Table 24 below. In the column labeled SEQ ID NO., the SEQ ID NOs. setting forth the amino acid sequence of the protease domains containing the indicated amino acid mutations are listed first; and the SEQ ID NOs. setting forth the sequence of amino acid residues that encodes the full-length MT-SP1 containing the indicated amino acid mutations is shown in parentheses. RFU numbers indicate the measured relative fluorescence units (rate of hydrolysis) for each substrate.

CAGCCC (SEQ ID NO.: 562) and reverse primer: pQE-Linear-R1:
TAATAAGCTTAATTAGCTGAGCTTGGACTCC (SEQ ID NO.: 563) followed by treatment of both the donor and acceptor PCR products with DpnI enzyme. For each linearizing primer sequence set forth above, the 18-nt long homology region, a non-annealing 5' primer tail, is shown in bold. Both acceptor and donor DNA were then mixed together, and the InFusion reaction was run in a 10 µL volume using conditions specified by the supplier. 2 µL of the reaction mix was transformed into 50 µL of *E. coli* TOP 10F' competent cells (Invitrogen, Carlsbad, Calif.). Colonies were selected on LB agar plates supplemented with 100 ppm Carbenicillin. Plasmid DNA was isolated from selected clones, and sequenced using the forward primer: MT-SP1-5F: GGAGAAACCGGCA-GAGTAC (SEQ ID NO.: 564) and reverse primer MT-SP1-5R: GGTTCTCGCAGGTGGTCTG (SEQ ID NO.: 565) to verify correct transfer. These primers are fully annealing.

TABLE 24

Kinetic assay of mutant MT-SP1 protease domains

| Mutant MT-SP1 Clone Number | Amino Acid Mutation (Chymotrypsin Numbering) | SEQ ID NO.: | Active Site Conc. | Ac-SLGR-ACC RFU/s | Ac-RQAR-ACC RFU/s | Ac-SLGR-KI QF RFU/s | Ac-RQAR-SA QF RFU/s |
|---|---|---|---|---|---|---|---|
| CPC-0025720 | C122S/H143R/Q175R | 522 (543) | 3.9 | 0.10 | 0.46 | 0.05 | 0.04 |
| CPC-0025876 | I41F/C122S/L171F | 523 (544) | 2.5 | 0.10 | 0.39 | 0.00 | 0.01 |
| CPC-0027399 | F99L/C122S | 527 (548) | 4.2 | 0.55 | 9.84 | 0.04 | 0.09 |
| CPC-0027797 | H71R/C122S/P131S/D217V | 529 (550) | 3.7 | 0.31 | 1.62 | 0.14 | 0.19 |
| CPC-0028017 | C122S/D217V | 530 (551) | 4.7 | 1.42 | 7.29 | 0.38 | 0.50 |
| CPC-0028333 | T65K/F93L/F97Y/C122S/D217V | 531 (552) | 3.6 | 1.05 | 5.97 | 0.37 | 0.51 |
| Template | C122S | 507 (515) | 3.5 | 0.22 | 3.58 | 0.05 | 0.06 |

Example 15

Expression of Selected MT-SP1 Mutant Proteins as Purified Protein

A. Transfer of MT-SP1 Protease Domain into pQE Vector

A subset of MT-SP1 protease domain-bearing phage clones assayed in the previous Examples was selected for transfer of the MT-SP 1 protease domain sequence, into a pQE30 expression vector that was previously modified for expression of wild-type MT-SP 1 protease domain. The InFusion DryDown PCR Cloning Kit (Clonetech) was used to transfer selected clones into pQE30-MT-SP1 (SEQ ID NO.: 624) using conditions specified by the supplier and as described by Benoit et al. (2006), Protein Expression & Purification 45:66-71. For this process, a portion of the phage clone DNA encoding the MT-SP1 protease domain was amplified by polymerase chain reaction (PCR) with the pQE-Insert-F2 forward primer: TTCACGAGACAGGCTCGTGT-TGTTGGGGGCACGGAT (SEQ ID NO.: 560) and pQE-Insert-R3 reverse primer: CAGCTAATTAAGCTTATTATACCCCAGTGTTCTCTTT (SEQ ID NO.: 561), each carrying non-annealing 5' tails. Plasmid pQE30-MT-SP1 without the protease domain of MT-SP1 was linearized using PCR with the forward primer: pQE-Linear-F2: ACGAGCCTGTCTCGTGAATGACCG- B. Expression, Refolding and Purification of Mutated MT-SP1 Protease Domains Plasmids encoding the protease domain of MT-SP1 variants in the pQE30 vector (Qiagen) described in Example 15B above were transformed into BL21-Gold(DE3)*E. coli* cells (Stratagene). Small starter cultures containing 1 mL LB supplemented with 100µg/mL Carbenicillin were inoculated from colonies and incubated for between 8 and 10 hours at 37° C. 100 µL of this culture was used to inoculate 50 mL of 2×YT medium supplemented with 100 µg/mL Carbenicillin and grown overnight. In 50 mL conical tubes (Corning), the cells were harvested by centrifugation then lysed. Inclusion bodies (IB) were isolated with BugBuster® Reagent (Novagen) using the conditions specified by the supplier. The IB pellets were solubilized with 1 mL of a denaturing solution containing 100 mM Tris pH 8, 6 M GdmHCL and 20 mM DTT. After removal of any insoluble material by centrifugation in microcentrifuge tubes (20,000 ×g for 10 min), the supernatant was diluted into 40 mL refolding solution, containing 1.5 M arginine, 100 mM Tris pH 8, 150 mM NaCl, 5 mM reduced glutathione and 50µM oxidized glutathione, in 50 mL conical tubes (Corning). The tubes were placed horizontally on a Nutator platform (Fisher Scientific) at 4° C. for 3-4 days. The refolded, not yet activated, MT-SP1 variants then were extensively dialyzed at room temperature against 25 mM Tris pH 8, 25 mM NaCl for 3-4 days Following the removal of arginine during dialysis, MT-SP1 protease domain variants were able to activate.

Crude preparations of activated MT-SP1 protease domain variants were then chromatographed on a 5 mL HiTrap™ Q HP column (GE Healthcare) attached to an AKTA system operating in an automated mode enabling the processing of up to seven variants per round. The running buffer was 25 mM Bis-Tris pH 6.5 and purified MT-SP1 was eluted within a 50 mL gradient to 350 mM NaCl. Active fractions were pooled, then buffer exchanged into PBS+20 mM benzamidine and concentrated to 0.5-10 mg/mL using Amicon-Ultra 15 devices (Millipore) with a MWCO of 10 kDa. Finally, aliquots were flash-frozen in liquid nitrogen and stored at −80° C.

Example 16

Preparation of Biotinylated Mutant PAI Inhibitor Baits

This Example describes methods that were used to express and purify mutant PAI inhibitor proteins, tagged with biotin for capture on streptavidin coated surfaces, for use in selecting variant uPA proteases from uPA libraries. These mutant PAI inhibitors are also useful for selection of one variant MT-SP1 proteases from MT-SP1 libraries, depending on the MT-SP1 variant and the RCL sequence used in the PAI.

A. N-Terminal Biotinylation of 6×His-PAI-1

For biotinylation of 6×His-PAI-1 or reactive center loop variants thereof, wild-type His-tagged PAI-1 (SEQ ID NO.: 625) and His-tagged PAI-1 variants, as described herein in Example 1, were transformed into the Rosetta-2 (DE3)pLysS host strain (Novagen). Expression was carried out essentially as described (Blouse, G. E., Perron, M. J., Thompson, J. H., Day, D. E., Link, C. A., and Shore, J. D. (2002) Biochemistry 41(40), 11997-12009), with the following modifications. Induction was carried out for three hours at 30° C. in 2×YT medium supplemented with 0.2% glucose, 100 ug/mL Carbenicillin and 10 ug/mL chloramphenicol (Cm). The active fraction of 6×His-PAI-1 then was purified from the cell lysates as described (Blouse, G. E., Perron, M. J., Kvassman, J. O., Yunus, S., Thompson, J. H., Betts, R. L., Lutter, L. C., and Shore, J. D. (2003) Biochemistry 42(42), 12260-12272; Kvassman, J.-O., and Shore, J. D. (1995) Fibrinolysis 9, 215-221).

6×His-PAI-1 variants were preferentially biotinylated at the N-terminus using the disulfide cleavable reagent EZ-Link NHS-SS-PEO$_4$-Biotin (PIERCE, Rockford, Ill. #21442). Reactions were carried out at pH 6.2, for 4 hours, at 4° C. on ice in a buffer containing 50 mM NaPi/300 mM NaCl/1 mM EDTA. The reaction was initiated by the addition of a 5-fold molar excess of biotinylation reagent dissolved in DMSO. The final concentration of DMSO in the reaction was maintained at below 1%. The Biotinylation reaction was quenched by the addition of 0.5 M Tris/1.0 NaCl/10 mM EDTA, pH 7.4 to a final Tris concentration of 20 mM. Excess biotinylation reagent was removed by extensive dialysis against a storage buffer containing 50 mM NaPi/300 mM NaCl/1 mM EDTA, pH 6.2. The concentration of PAI-1 in the resulting solution was confirmed using an extinction coefficient of 0.93 mL mg$^{-1}$ cm$^{-1}$ (see: Kvassman, J.-O., and Shore, J. D. (1995) Fibrinolysis 9, 215-221). The extent of biotinylation was determined using the EZ-Quant HABA/Avidn kit (PIERCE, Rockford, Ill. #28005), following the supplier-specified conditions, and was typically between 1.0 and 1.2 moles biotin per 1 mole PAI-1 variant.

B. In Vivo Biotinylation of PAIs: Biotinylation of BRS-TEV-OptiPAI-1$^{stab}$ In Vivo This Example describes a method that was used to in vivo biotinylate PAI. In this Example, an appropriate recognition sequence was incorporated into the gene encoding the bait molecule so that the biotin-tagging of the bait could be accomplished in growing cells, instead of being carried out with purified bait in vitro. A gene encoding stable PAI-1 protein (PAI-1$^{stab}$, having the sequence of amino acid residues set forth in SEQ ID NO.: 567), which has N150H, K154T, Q319L and M354I mutations (Berkenpas, M. B., Lawrence, D. A., and Ginsburg, D. (1995) EMBO J. 14(13), 2969-2977), was designed to contain the following regions in the following order: 1) Start codon, 2) Biotin Recognition Sequence (BRS), 3) Tobacco Etch Virus Protease Sequence (TEV) 4) PAI coding sequence 5) stop codon; with *Escherichia coli* codon optimization. This synthetic PAI-1$^{stab}$ gene was cloned into the commercial expression vector pET21-a (Novagen, Madison, Wis.) (SEQ ID NO.: 566) using XbaI and HindIII restriction enzymes resulting in plasmid pCAT0002 (SEQ ID NO: 619), which expressed Optimized PAI-1 (OptiPAI-1; encoded by the amino acid sequence set forth in SEQ ID NO.: 621, in which amino acid residue positions 3-17 and 20-26 correspond to the BRS and TEV sites, respectively) using the T7 expression system. Plasmid pCAT0002 was then co-transformed into *E. coli* BL21-Gold (DE3) competent cells (Stratagene, San Diego, Calif.) carrying the plasmid pBirA (described in Asai et al., (1999) J. Biol. Chem. 274:20079-20078), which overexpresses the *E. coli* biotin ligase, BirA. Transformants were selected on Luria-Bertani (LB) agar plates supplemented with 100 ug/mL Carbenicillin and 10 µg/mL chloramphenicol (Cm).

Expression of BRS-TEV-OptiPAI-1$^{stab}$ (SEQ ID NO.: 621) and reactive center loop variants thereof was carried out essentially as described (Blouse, G. E., Perron, M. J., Thompson, J. H., Day, D. E., Link, C. A., and Shore, J. D. (2002) Biochemistry 41(40), 11997-12009), with the following modifications. Induction was initiated by the addition of 0.1 mM IPTG and 0.1 mM D-biotin for three hours at 30° C. in 2×YT medium supplemented with 0.2% glucose, 100 µg/mL Carbenicillin and 10 µg/mL chloramphenicol (Cm). The active fraction of BRS-TEV-OptiPAI-1$^{stab}$ was subsequently purified from the cell lysates as described (see: Blouse, G. E., Perron, M. J., Kvassman, J. O., Yunus, S., Thompson, J. H., Betts, R. L., Lutter, L. C., and Shore, J. D. (2003) Biochemistry 42(42), 12260-12272; and Kvassman, J.-O., and Shore, J. D. (1995) Fibrinolysis 9, 215-221) or by selection by chromatography on monomeric avidin (PIERCE, Rockford, Ill. #20227), following the conditions specified by the supplier, with the following modifications. The binding buffer contained 50 mM Tris/100 mM NaCl/1 mM EDTA/0.01% tween-80 and had a pH of 7.4; and a competitive elution buffer was used that contained this binding buffer plus 2 mM D-biotin. Biotin from the competitive elution step was removed by extensive dialysis against a storage buffer containing 50 mM NaPi/300 mM NaCl/1 mM EDTA, pH 6.2. The PAI-1 concentration was confirmed using an extinction coefficient of 0.93 mL mg$^{-1}$ cm$^{-1}$ as described (Kvassman, J.-O., and Shore, J. D. (1995) Fibrinolysis 9, 215-221).

C. In Vitro Biotinylation Of V1C OptiPAI-1$^{stab}$

This Example sets forth methods for N-terminal Biotinylation of a PAI variant. The methods described in this Example were carried out to incorporate an appropriate reactive group into the gene encoding the PAI bait molecule, such that the tagging of the bait with biotin could be accomplished after the protein had been purified, allowing position-specific labeling of the bait. In this Example, since native PAI does not contain any cysteine residues, a cysteine codon was added to the DNA encoding the PAI gene to create a Cys-containing PAI that could then be reacted with Cys-reactive biotinylation reagents.

The N-terminal BRS-TEV sequence of OptiPAI-1, in plasmid pCAT0002 described above, was deleted with simultaneous introduction of V1C mutation using the QuikChange-XL mutagenesis Kit (Stratagene, San Diego, Calif.), according to supplier specifications, resulting in plasmid pCAT0051 (SEQ ID NO.: 623) expressing V1C OptiPAI-1$^{stab}$ protein (SEQ ID NO.: 622). Plasmid pCAT0051 was transformed into E. coli BL21(DE3) pLysS competent cells (Stratagene, San Diego, Calif.). Transformants were selected on Luria-Bertani (LB) agar plates supplemented with 100 ug/mL Carbenicillin and 10 ug/mL chloramphenicol (Cm).

Expression of the V1C OptiPAI-1$^{stab}$ protein and reactive center loop variants thereof was carried out essentially as described (Blouse, G. E., Perron, M. J., Thompson, J. H., Day, D. E., Link, C. A., and Shore, J. D. (2002) Biochemistry 41(40), 11997-12009), with the following modifications. Induction was initiated by the addition of 0.1 mM IPTG for three hours at 30° C. in 2×YT medium that was supplemented with 0.2% glucose, 100 ug/mL Carbenicillin and 10 ug/mL chloramphenicol. The active fraction of the V1C OptiPAI-1$^{stab}$ or variant thereof was purified from the cell lysates as described (Blouse, G. E., Perron, M. J., Kvassman, J. O., Yunus, S., Thompson, J. H., Betts, R. L., Lutter, L. C., and Shore, J. D. (2003) Biochemistry 42(42), 12260-12272; and Kvassman, J.-O., and Shore, J. D. (1995) Fibrinolysis 9, 215-221).

The V1C OptiPAI-1 proteins and variants were biotinylated at the engineered N-terminal cysteine residue using the thiol-reactive and reversible biotinylation reagent, EZ-Link Biotin-HPDP(N-(6-(Biotinamido)hexyl)-3'-(2'-pyridyldithio)propionamide) (PIERCE, Rockford, Ill. #21341). Biotin conjugation was accomplished according to the supplier specifications, with some modifications, as follows. Stock solutions of biotin-HPDP were prepared at 5 mg/mL in anhydrous DMF (9.3 mM). V1C OptiPAI-1$^{stab}$ was rapidly desalted on G-25 gel filtration column, from which it was eluted into a conjugation buffer containing 50 mM NaPi/150 mM NaCl/1 mM EDTA/0.01% Tween-80, pH 7.4. Biotinylation reactions were initiated by the addition of a 10-fold molar excess of stock Biotin-HPDP. The final concentration of dimethylformamide (DMF) was maintained below 2-3%.

Reactions were carried out for 4 hours at 25° C. and the reaction progress followed using release of the pyridine-2-thione leaving group at 343 nm. Excess biotinylation reagent was removed by extensive dialysis against a storage buffer containing 50 mM NaPi/300 mM NaCl/1 mM EDTA, pH 6.2. The PAI-1 concentration was confirmed using an extinction coefficient of 0.93 mL mg$^{-1}$ cm$^{-1}$ as described (Kvassman, J.-O., and Shore, J. D. (1995) Fibrinolysis 9, 215-221). The extent of biotinylation was typically 1.0-1.2 moles of biotin per mole of PAI-1 variant using the EZ-Quant HABA/Avidin kit and the release of pyridin-2-thione (PIERCE, Rockford, IL #28005).

Example 17

Screening of MT-SP1 Variants from E. coli Culture Supernatants and Periplasmic Extracts This Example describes two methods, each used as an alternative to screening the activity of MT-SP1 variants on phage by assaying either the protein from the E. coli periplasmic space or the protein from E. coli cell culture medium.

For both methods, 1 mL cultures were prepared as follows. 1 mL of 2YT medium supplemented with 100 ug/mL Carbenicillin and 12 ug/mL Tetracycline were dispensed into each well of a 96 well deep well plate, and inoculated with 10 µL of XL-1 Blue cells that had been infected with MT-SP1 protease domain-bearing phage overnight as described in Example 14 above, from a 96 well master plate. The deep well plate was sealed with an air-permeable membrane and placed in a HiGro shaker incubator with shaking at 400 rpm at 37° C. with oxygen aeration until the cell density reached 0.4-0.6 OD600 (usually 4-5 hours of shaking). At that point IPTG was added to a final concentration of 0.5 mM, and growth with shaking was continued overnight. The following day, the plate was centrifuged at 3600 rpm for 20 min to pellet the cells.

A. Screening of MT-SP1 variants from Periplasmic preps

The methods in this example were used to assay the full length MT-SP1-gene III fusion proteins, and enzymatically active cleavage products of the fusion proteins, that had been transported into the E. coli periplasmic space. After the centrifugation at 3600 rpm, the culture supernatant was discarded and the cell pellet was used to release periplasmic proteins using either of the following conditions: Condition 1: The cell pellets were resuspended in 150 µL cold phosphate buffered saline (PBS); the suspension was transferred a 96 well PCR plate; followed by one step freeze thawing (20 min at −80° C. / 10 min in a room temperature water bath); or Condition 2: The cell pellets were resuspended in 150 uL of 3% BugBuster Protein Extraction Reagent (Novagen); the suspension was transferred to a 96 well PCR plate; and the suspension was incubated at room temperature for 30 min. Next, the cell suspensions were centrifuged for 20 min at 3600 rpm at 4° C. and the supernatants containing periplasmic proteins were carefully removed without disturbing the pellet. Further, the periplasmic extracts were used to determine enzyme activity of the MT-SP1 variants using appropriate substrates as described in Example 10, Section B.

B. Screening Of MT-SP1 Variants From Supernatant Preps

The methods in this example were used to assay the full length MT-SP 1-gene III fusion proteins, and catalytically active fragments of the fusion protein, that had diffused from the periplasm and into the bacterial cell culture media. In this example, after centrifugation in the 1 mL culture, 10 µL of the culture supernatant were removed and assayed using the protease assay described in Example 10, Section B, except an additional 25 µL of assay buffer was added to the reaction.

Since modifications will be apparent to those of skill in this art, it is intended that this invention be limited only by the scope of the appended claims.

SEQUENCE LISTING (645 sequences)

SEQ ID NO: 1 - protein, 418 aa, Homo sapiens
  Alpha-1-antitrypsin precursor SERPINA1
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 2 - protein, 420 aa, Homo sapiens
  Alpha-1-antitrypsin-related precursor SERPINA2
MPFSVSWGVLLLAGLCCLVPSSLVEDPQGDAAQKTDTSHHDQGDWEDLACQKISYNVTDLAFDLYKSWLIYHNQHVLVTPTSVAMAFRMLSLGTKADTRTEILEGLNVNLTETPEAKIHECFQQVLQALSRPDTRLQLTTGSSLFVNKSMKLVDTFLEDTKKLYHSEASSINFRDTEEAKEQINNYVEKRTGRKVVDLVKHLKKDTSLALVDYISFHGKWKDKFKAERIMVEGFHVDDKTIIRVPMINHLGRFDIHRDRELSSWVLAQHYVGNATAFFILPDPKKMWQLEEKLTYSHLENIQRAFDIRSINLHFPKLSISGTYKLKRVPRNLGITKIFSNEADLSGVSQEAPLKLSKAVHVAVLTIDEKGTEATGAPHLEEKAWSKYQTVMFNRPFLVIIKEYITNFPLFIGKVVNPTQK

SEQ ID NO: 3 - protein, 490 aa, Homo sapiens
  Alpha-2-antiplasmin SERPINF2
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSP

SEQ ID NO: 4 - protein, 423 aa, Homo sapiens
  Alpha-1-antichymotrypsin precursor SERPINA3
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 5 - protein, 464 aa, Homo sapiens
  Antithrombin-III precursor SERPINC1
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 6 - protein, 499 aa, Homo sapiens
  Heparin cofactor 2 precursor SERPIND1
MKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 7 - protein, 500 aa, Homo sapiens
  Plasma protease C1 inhibitor precursor SERPING1
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 8 - protein, 406 aa, Homo sapiens
  Plasma serine protease inhibitor precursor SERPINA5
MQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 9 - protein, 427 aa, Homo sapiens
  Kallistatin precursor SERPINA4
MHLIDYLLLLLVGLLALSHGQLHVEHDGESCSNSSHQQILETGEGSPSLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAKFLNDTMAVYEAKLFHTNFYDTVGTIQLINDHVKKETRGKIVDLVSELKKDVLMVLVNYIYFKALWEKPFISSRTTPKDFYVDENTTVRVPMMLQDQEHHWYLHDRYLPCSVLRMDYKGDATVFFILPNQGKMREIEEVLTPEMLMRWNNLLRKRNFYKKLELHLPKFSISGSYVLDQILPRLGFTDLFSKWADLSGITKQQKLEASKSFHKATLDVDEAGTEAAAATSFAIKFFSAQTNRHILRFNRPFLVVIFSTSTQSVLFLGKVVDPTKP

SEQ ID NO: 10 - protein, 410 aa, Homo sapiens
  Neuroserpin precursor SERPINII
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 11 - protein, 402 aa, Homo sapiens [sequence omitted]

SEQ ID NO: 12 - protein, 405 aa, Homo sapiens
  Myoepithelium-derived serine protease inhibitor SERPIN12
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 13 - protein, 444 aa, Homo sapiens
  Protein Z-dependent protease inhibitor precursor SERPINA10
MKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 14 - protein, 398 aa, Homo sapiens
  Glia-derived nexin precursor SERPINE2
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITTGSENLHVSHILQKAKIEVSEDGTKASAATTAILIARSSPPWFIVDRPFLFFIRHNPTGAVLFMGQINKP

SEQ ID NO: 15 - protein, 379 aa, Homo sapiens
  Leukocyte elastase inhibitor SERPINB1
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 16 - protein, 415 aa, Homo sapiens
  Plasminogen activator inhibitor 2 precursor SERPINB2
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 17 - protein, 376 aa, Homo sapiens
  Placental thrombin inhibitor SERPINB6
MDVLAEANGTFALNLLKTLGKDNSKNVFFSPMSMSCALAMVYMGAKGNTAAQMAQILSFNKSGGGGDIHQGFQSLLTEVNKTGTQYLLRVANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 18 - protein, 397 aa, Homo sapiens
  Bomapin SERPINB10
MDSLATSINQFALELSKKLAESAQGKNIFFSSWSISTSLTIVYLGAKGTTAAQMAQVLQFNRDQGVKCDPESEKKRKMEFNLSNSEEIHSDFQTLISEILKPNDDYLLKTANAIYGEKTYAFHNKYLEDMKTYFGAEPQPVNFVEASDQIRKDINSWVERQTEGKIQNLLPDDSVDSTTRMILVNALYFKGIWEHQFLVQNTTEKPFRINETTSKPVQMMFMKKKLHIFHIEKPKAVGLQLYYKSRDLSLLILLPEDINGLEQLEKAITYEKLNEWTSADMMELYEVQLHLPKFKLEDSYDLKSTLSSMGMSDAFSQSKADFSGMSSARNLFLSNVFHKAFVEINEQGTEAAAGSGSEIDIRIRVPSIEFNANHPFLFFIRHNKTNTILFYGRLCSP

SEQ ID NO: 19 - protein, 392 aa, Homo sapiens [sequence omitted]

SEQ ID NO: 20 - protein, 405 aa, Homo sapiens
  Yukopin SERPINB12
MDSLVTANTKFCFDLFQEIGKDDRHKNIFFSPLSLSAALGMVRLGARSDSAHQIDEVLHFNEFSQNESKEPDPCLKSNKQKAGSLNNESGLVSCYFGQLLSKLDRIKTDYTLSIANRLYGEQEFPICQEYLDGVIQFYHTTIESVDFQKNPEKSRQEINFWVECQSQGKIKELFSKDAINAETVLVLVNAVYFKAKWETYFDHENTVDAPFCLNANENKSVKMMTQKGLYRIGFIEEVKAQILEMRYTKGKLSMFVLLPSHSKDNLKGLEELERKITYEKMVAWSSSENMSEESVVLSFPRFTLEDSYDLNSILQDMGITDIFDETRADLTGISPSPNLYLSKIIHKTFVEVDENGTQAAAATGAVVSERSLRSWVEFNANHPFLFFIRHNKTQTILFYGRVCSP

SEQ ID NO: 21 - protein, 391 aa, Homo sapiens
  Headpin SERPINB13
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 22 - protein, 390 aa, Homo sapiens
  Squamous cell carcinoma antigen 1 SERPINB3
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKNTYKSIQMMRQYTSFHFASLEDVQAKVLEIPYKGKDLSMIVLLPNEIDGLQKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHCNHPFLFFIRQNKTNSILFYGRFSSP

SEQ ID NO: 23 - protein, 390 aa, Homo sapiens
  Squamous cell carcinoma antigen 2 SERPINB4
MNSLSEANTKFMFDLFQQFRKSKENNIFYSPISITSALGMVLLGAKDNTAQQISKVLHFDQVTENTTEKAATYHVDRSGNVHHQFQKLLTEFNKSTDAYELKIANKLFGEKTYQFLQEYLDAIKKFYQTSVESTDFANAPEESRKKINSWVESQTNEKIKNLFPDGTIGNDTTLVLVNAIYFKGQWENKFKKENTKEEKFWPNKNTYKSVQMMRQYNSFNFALLEDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 24 - protein, 380 aa, Homo sapiens
  Megsin SERPINB7
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVERVDFTNHLEDTRRNINKWVENETHGKIKNVIGEGGISSSAVMVLVNAVYFKGKWQSAFTKSETINCHFKSPKCSGKAVAMMHQERKFNLSVIEDPSMKILELRYNGGINMYVLLPENDLSEIENKLTFQNLMEWTNPRRMTSKYVEVFFPQFKIEKNYEMKQYLRALGLKDIFDESKADLSGIASGGRLYISRMMHKSYIEVTEEGTEATAATGSNIVEKQLPQSTLFRADHPFLFVIRKDDIILFSGKVSCP

SEQ ID NO: 25 - protein, 374 aa, Homo sapiens
  Cytoplasmic antiproteinase 2 SERPINB8
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVVEKALTYEKFKAWTNSEKLTKSKVQVFLPRLKLEESYDLEPFLRRLGMIDAFDEAKADFSGMSTEKNVPLSKVAHKCFVEVNEEGTEAAAATAVVRNSRCSRMEPRFCADHPFLFFIRRHKTNCILFCGRFSSP

SEQ ID NO: 26 - protein, 376 aa, Homo sapiens
  Cytoplasmic antiproteinase 3 SERPINB9
METLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQEEQRPVQMMYQEATFKLAHVGEVRAQLLELPYARKELSLLVLLPDDGVELSTVEKSLTFEKLTAWTKPDCMKSTEVEVLLPKFKLQEDYDMESVLRHLGIVDAFQQGKADLSAMSAERDLCLSKFVHKSFVEVNEEGTEAAAASSCFVVAECCMESGPRFCADHPFLFFIRHNRANSILFCGRFSSP

SEQ ID NO: 27 - protein, 376 aa, Homo sapiens; identical to SEQ ID NO: 17
  Placental thrombin inhibitor SERPINB6

SEQ ID NO: 28 - protein, 485 aa, Homo sapiens
  Angiotensinogen precursor SERPINA8
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 29 - protein, 405 aa, Homo sapiens
  Corticosteroid-binding globulin precursor SERPINA6
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDSELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 30 - protein, 417 aa, Homo sapiens
  47 kDa heat shock protein precursor SERPINH1
MRSLLLGTLCLLAVALAAEVKKPVEAAAPGTAEKLSSKATTLAEPSTGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFPDKRSALQSINEWAAQTTDGKLPEVTKDVERTDGALLVNAMFFKPHWDEKFHHKMVDNRGFMVTRSYTVGVTMMHRTGLYNYYDDEKEKLQLVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRLKGDKMRDEL

SEQ ID NO: 31 - protein, 418 aa, Homo sapiens [sequence omitted]

SEQ ID NO: 32 - protein, 375 aa, Homo sapiens
  Maspin SERPINB5
MDALQLANSAFAVDLFKQLCEKEPLGNVLFSPICLSTSLSLAQVGAKGDTANEIGQVLHFENVKDIPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFPESETKECPFRLNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 33 - protein, 418 aa, Homo sapiens
  Collagen-binding protein 2 precursor SERPINH2
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 34 - protein, 415 aa, Homo sapiens
  Thyroxine-binding globulin precursor SERPINA7
MSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 35 - protein, 417 aa, Homo sapiens [sequence omitted]

SEQ ID NO: 36 - protein, 414 aa, Homo sapiens
  Vaspin SERPINA12
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 37 - protein, 422 aa, Homo sapiens
  Serpin A11 precursor SERPINA11
MGPAWLWLLGTGILASVHCQPLLAHGDKSLQGPQPPRHQLSEPAPAYHRITPTITNFALRLYKELAADAPGNIFFSPVSISTTLALLSLGAQANTSALILEGLGFNLTETPEADIHQGFRSLLHTLALPSPKLELKVGNSLFLDKRLKPRQHYLDSIKELYGAFAFSANFTDSVTTGRQINDYLRRQTYGQVVDCLPEFSQDTFMVLANYIFFKAKWKHPFSRYQTQKQESFFVDERTSLQVPMMHQKEMHRFLYDQDLACTVLQIEYRGNALALLVLPDPGKMKQVEAALQPQTLRKWGQLLLPSLLDLHLPRFSISGTYNLEDILPQIGLTNILNLEADFSGVTGQLNKTISKVSHKAMVDMSEKGTEAGAASGLLSQPPSLNTMSDPHAHFNRPFLLLLWEVTTQSLLFLGKVVNPVAG

SEQ ID NO: 38 - protein, 307 aa, Homo sapiens
  Serpin A13 precursor SERPINA13
MEASRWWLLVTVLMAGAHCVALVDQEASDLIHSGPQDSSPGPALPCHKISVSNIDFAFKLYRQLALNAPGENILFFPVSISLALAMLSWGAPVASRTQLLEGLGFTLTVVPEEEIQEGFWDLLIRLRGQGPRLLLTMDQRRFSGLGARANQSLEEAQKHIDEYTEQQTQGKLGAWEKDLGSETTAVLVNHMLLRAEWMKPFDSHATSPKEFFVDEHSAVWVPMMKEKASHRFLHDRELQCSVLRMDHAGNTTTFFIFPNRGKMRHLEDALLPETLIKWDSLLRTRELDFHFPKFSISRTCRLEMLLP

SEQ ID NO: 39 - DNA, 934 bp, Homo sapiens
  granzyme B
tgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 40 - protein, 247 aa, Homo sapiens
  granzyme B
MQPILLLLAFLLLPRADAGEIIGGHEAKPHSRPYMAYLMIWDQKSLKRCGGFLIQDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 41 - DNA, 1165 bp, Homo sapiens
  Testisin transcript variant 1
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 42 - protein, 314 aa, Homo sapiens
  Testisin isoform 1
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 43 - DNA, 1159 bp, Homo sapiens
  Testisin transcript variant 2
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 44 - protein, 312 aa, Homo sapiens
  Testisin isoform 2
MGARGALLLALLLARAGLRKPESQEAAPLSGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 45 - DNA, 1135 bp, Homo sapiens
  Testisin transcript variant 3
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaaaaaaaaaaaaaa

SEQ ID NO: 46 - protein, 300 aa, Homo sapiens
  Testisin isoform 3
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMGDSGGPLACNKNGLWYQIGVVSWGVGCGRPNRPGVYTNISHHFEWIQKLMAQSGMSQPDPSWPLLFFPLLWALPLLGPV

SEQ ID NO: 47 - DNA, 1194 bp, Homo sapiens
  trypstase beta 1
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatca

SEQ ID NO: 48 - protein, 275 aa, Homo sapiens
  trypstase beta 1
MLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 49 - DNA, 1528 bp, Homo sapiens
  kallikrein hk5
ggaaggcacaggcctgagaagtctgcggctgagctgggagcaaatcccccaccccctacctgggggacagggcaagtgagacctggtgagggtggctcagcaggaagggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaaaaaaaaaaaaaaaaaaaaaaaaaaaa

SEQ ID NO: 50 - protein, 293 aa, Homo sapiens
  kallikrein hk5
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 51 - DNA, 4942 bp, Homo sapiens
  Corin
aaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaa

SEQ ID NO: 52 - protein, 1042 aa, Homo sapiens
  Corin
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 53 - DNA, 945 bp, Homo sapiens
  kallikrein 12 transcript variant 1
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaactccactcttgttggcctgggaacttcttggaactttaactcctgccagcccttctaagacccacgagcggggtgagagaagtgtgcaatagtctggaataaatataaatgaaggaggggc

SEQ ID NO: 54 - protein, 254 aa, Homo sapiens
  kallikrein 12 isoform 1
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICNSTLVGLGTSWNFNSCQPF

SEQ ID NO: 55 - DNA, 1074 bp, Homo sapiens
  kallikrein 12 transcript variant 2
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 56 - protein, 248 aa, Homo sapiens
  kallikrein 12 isoform 2
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICKYVDWIRMIMRNN

SEQ ID NO: 57 - DNA, 814 bp, Homo sapiens
  kallikrein 12 transcript variant 3
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 58 - protein, 111 aa, Homo sapiens
  kallikrein 12 isoform 3
MGLSIFLLLCVLGLSQAATPKIFNGTECGRNSQPWQVGLFEGTSLRCGGVLIDHRWVLTAAHCSGRPIPGSAPVPQPLHRLPCHLPWCVSRENHEQHGVCRRRPGAGCLPG

SEQ ID NO: 59 - DNA, 1471 bp, Homo sapiens
  DESC1 oritease
tgacttggatgtagacctcgaccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcaaaaaaaaaa

SEQ ID NO: 60 - protein, 422 aa, Homo sapiens
  DESC1 oritease
MYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 61 - DNA, 1124 bp, Homo sapiens
  tryptase gamma 1
ccatggcccttggggcctgtggcctcctgctgctcctggctgtgcccggtgtgtccctcaggactttgcagccagggtgtggccggccgcaggtttcggatgcaggcggccggatcgtggggggtcacgctgccccggccggcgcatggccatggcaggccagcctccgcctgcggaggatgcacgtgtgcggcgggtcactgctcagcccccagtgggtgctcacagctgcccactgcttctccgggtccctgaactcatccgactaccaggtgcacctgggggaactggagatcactttgtctccccacttctccaccgtgaggcagatcatcctgcactccagcccctcaggacagccggggaccagcggggacatcgccctggtggagctcagtgtccccgtgaccctctccagccggatcctgcccgtctgcctcccggaggcctcagatgacttctgccctgggatccggtgctgggtgaccggctggggctatacgcgggagggagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggacgactccggggggcctctggtctgccaggtgaacggtgcctgggtgcaggctggcattgtgagctggggtgagggctgcggccgccccaacaggccgggagtctacactcgtgtccctgcctacgtgaactggatccgccgccacatcacagcatcagggggctcagagtctgggtaccccaggctccccctcctggctggcttcttcctccccggcctcttccttctgctagtctcctgtgtcctgctggccaagtgcctgctgcacccatctgcggatggtactcccttccccgcccctgactgatggcaggaatccaagtgcatttcttaaataagttactatttattccgctccgccccctccctctcccttgagaagctgagtcttctgcatcagattattgcaacatttaacctgaatttaaaagcacacgaaacaaaaaaaaaaaaaaaaaaaaaa

SEQ ID NO: 62 - protein, 321 aa, Homo sapiens
  tryptase gamma 1
MALGACGLLLLLAVPGVSLRTLQPGCGRPQVSDAGGRIVGGHAAPAGAWPWQASLRLRRMHVCGGSLLSPQWVLTAAHCFSGSLNSSDYQVHLGELEITLSPHFSTVRQIILHSSPSGQPGTSGDIALVELSVPVTLSSRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGIVSWGEGCGRPNRPGVYTRVPAYVNWIRRHITASGGSESGYPRLPLLAGFFLPGLFLLLVSCVLLAKCLLHPSADGTPFPAPD

SEQ ID NO: 63 - DNA, 1459 bp, Homo sapiens
  kallikrein hK14
gcacctagcagatcccaagctggggaatgccagttctggcaccaaccttcctgctccctgctggggcctctgctcccccatctctcaggagtcgaaagtgagaaagcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacggtgggatggacctcgtcagctgcccaggccctcctctctctactcaggacccaggagtccaggccccagcccctcctccctcagacccaggagtccaggcccccagcccctcctccctcagacccgggagtccaggcccccagcccctcctccctcagacccaggagccccagtccccagcatcctgatctttactccggctctgatctctcctttcccagagcagttgcttcaggcgttttctccccaccaagcccccacccttgctgtgtcaccatcactactcaagaccggaggcacagagggcaggagcacagaccccttaaaccggcattgtattccaaagacgacaatttttaacacgcttagtgtctctaaaaaccgaataaataatgacaataaaaatggaatcatcctaaattgta

SEQ ID NO: 64 - protein, 251 aa, Homo sapiens
  Kallikrein-14 precursor S01.029
MFLLLTALQVLAIAMTQSQEDENKIIGGHTCTRSSQPWQAALLAGPRRRFLCGGALLSGQWVITAAHCGRPILQVALGKHNLRRWEATQQVLRVVRQVTHPNYNSRTHDNDLMLLQLQQPARIGRAVRPIEVTQACASPGTSCRVSGWGTISSPIARYPASLQCVNINISPDEVCQKAYPRTITPGMVCAGVPQGGKDSCQGDSGGPLVCRGQLQGLVSWGMERCALPGYPGVYTNLCKYRSWIEETMRDK

SEQ ID NO: 65 - DNA, 3008 bp, Homo sapiens
  hyaluronan-binding serine protease (HGF activator-like protein)
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggcatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaag

SEQ ID NO: 66 - protein, 560 aa, Homo sapiens
  hyaluronan-binding serine protease (HGF activator-like protein)
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 67 - DNA, 2124 bp, Homo sapiens
  transmembrane protease, serine 4 transcript variant 1
aatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggaaaaaaaaaaaaaaaa

SEQ ID NO: 68 - protein, 437 aa, Homo sapiens
  transmembrane protease, serine 4 isoform 1
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 69 - DNA, 1983 bp, Homo sapiens
  transmembrane protease, serine 4 transcript variant 2
aatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggaaaaaaaaaaaaaaaaaaaaaaaa

SEQ ID NO: 70 - protein, 335 aa, Homo sapiens
  transmembrane protease, serine 4 isoform 2
MDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGG

SEQ ID NO: 71 - DNA, 855 bp, Homo sapiens
  tryptase delta 1
aggcccacgatgctcctccttgctccccagatgctgagcctgctgctgctggcgctgcccgtcctggcgagcccggcctacgtggcccctgccccaggccaggccctgcagcaaacgggcattgttggggggcaggaggcccccaggagcaagtggccctggcaggtgagcctgagagtccgcggcccatactggatgcacttctgcgggggctccctcatccacccccagtgggtgctaaccgcggcgcactgcgtggaaccggacatcaaggatctggccgccctcagggtgcaactgcgggagcagcacctctactaccaggaccagctgctgccggtcagcaggatcatcgtgcacccacagttctacatcatccagaccggggcggacatcgccctgctggagctggaggagcccgtgaacatctccagccacatccacacggtcacgctgccccctgcctcggagaccttccccccggggatgccgtgctgggtcactggctggggcgacgtggacaataatgtgcacctgccgccgccatacccgctgaaggaggtggaagtccccgtagtggaaaaccacctttgcaacgcggaatatcacaccggcctccatacgggccacagctttcaaatcgtccgcgatgacatgctgtgtgcggggagcgaaaatcacgactcctgccagggtgactctggagggcccctggtctgcaaggtgaatggcacctaactgcaggcgggcgtggtcagctgggaggagagctgtgcccagcccaaccggcctggcatctacacccgtgtcacctactacttggactggatccaccactatgtccccaagaagccc

SEQ ID NO: 72 - protein, 242 aa, Homo sapiens
  tryptase delta 1
MLLLAPQMLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 73 - DNA, 1462 bp, Homo sapiens
  Marapsin
ctgtctcaaaaaattaaaaaaaataataataataataatgaatgaagctggacggacttcgcgtgcaccgcggtcagctcggggtctgctggggggtctgggtcagctcagggtccaggaaccgaggccaacggcaccccgtgctgcgctggggtgaggggtctgccctggggtctcggggttcagggctaggtcacggaggagtcggctctgggcgcttccttcctgaggagaggagctgggcaggccgggccgacgggttgggccgcatagccgggcctgtgctcatctccagcataaaactccacttcatggagcctgcacctcgctcgtgctccaacgcttctgccaccgccgaccacggccctgcgccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaacacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgcca

SEQ ID NO: 74 - protein, 290 aa, Homo sapiens
  Marapsin
MRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 75 - DNA, 1755 bp, Homo sapiens
  Tryptase homologue 2
ccaggacttccgtctgagatgggatttctggacagaacaatggagcgcagaagctccagcaacgtgtgctctgcagggagcccagaccagagtccaagccctaggcagtgccacccttacccagcccagccttgaagacagaatgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagggtgattctgggggacctctgacctgcctgcagtctgggagctgggtcctggtgggcgtggtgagctggggcaagggttgtgccctgcccaaccgtccaggggtctacaccagtgtggccacatatagcccctggattcaggctcgcgtcagcttctaatgctagccggtgaggctgacctggagccagctgctggggtccctcagcctcctggttcatccaggcacctgcctataccccacatcccttctgcctcgaggccaagatgcctaaaaaagctaaaggccaccccaccccccacccaccacctcctgcctcctctcctctttggggatcaccagctctgactccaccaaccctcatccaggaatctgccatgagtcccagggagtcacactccccactcccttcctggcttgtatttacttttcttggccctggccagggctgggcgcaaggcacgcagtgatgggcaaaccaattgctgcccatctggcctgtgtgcccatctttttctggagaaagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttgaacccaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 76 - protein, 284 aa, Homo sapiens
  Tryptase homologue 2
MRGVSCLQVLLLLVLGAAGTQGRKSAACGQPRMSSRIVGGRDGRDGEWPWQASIQHPGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQGDSGGPLTCLQSGSWVLVGVVSWGKGCALPNRPGVYTSVATYSPWIQARVTSNASR

SEQ ID NO: 77 - DNA, 321 bp, Homo sapiens
  Tryptase homologue 3
gcgctggtggcgggcggagtggagtccgcgcgcgggcgctggccatggcaggccagcctgcgcctgaggagacgccaccgatgtggagggagcctgctcagccgccgctgggtgctctcggctgcgcactgcttcgctccccagggtgactcaggtggacccttggtctgtgacaaggatggactgtggtatcaggttggaatcgtgagctggggaatggactgcggtcaacccaatcggcctggtgtctacaccaacatcagtgtgtacttccactggatccggagggtgatgtcccacagtacacccaggccaaacccc

SEQ ID NO: 78 - protein, 107 aa, Homo sapiens
  Tryptase homologue 3
ALVAGGVESARGRWPWQASLRLRRRHRCGGSLLSRRWVLSAAHCFAPQGDSGGPLVCDKDGLWYQVGIVSWGMDCGQPNRPGVYTNISVYFHWIRRVMSHSTPRPNP

SEQ ID NO: 79 - DNA, 2468 bp, Homo sapiens
  transmembrane protease, serine 3 transcript variant A
accgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcaaaaaaaaaaaaaaaaaaaaaaaaaaaaaaa

SEQ ID NO: 80 - protein, 454 aa, Homo sapiens
  transmembrane protease, serine 3 isoform 1
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 81 - DNA, 2554 bp, Homo sapiens
  transmembrane protease, serine 3 transcript variant B
gccacgttggattagggcccaccctaatgactcattttaactagatgactctgtaaagactctccaggccatctccaaataagatgccattctgaggtactaagagttaagacctcaacgtgtctttctgggggatactattcaacccatagcacatcccctcatcccccatggaataaccgggtcagaggtggagcaggtaggactgaactagagaatgtgccccttggtgggtggccctttccctaattaaggcacctttctttgggctgagacttctctgcaaagaggggagggggaaaggatagttaaatttgtaagtttcatggcactccaagtcaggttctggggctttctgctcttcctttttctggttatcagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcaaaaaaaaaaaaaaaaaaaaaaaaaaaaaaa

SEQ ID NO: 82 - protein, 327 aa, Homo sapiens
  transmembrane protease, serine 3 isoform 2
MCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 83 - DNA, 2135 bp, Homo sapiens
  transmembrane protease, serine 3 transcript variant  C
gcagggggacagttgttagtgttgcactctgaaagagctgttggttaattcctgccttcctcccttttcccagtccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcaaaaaaaaaaaaaaaaaaaaaaaaaaaaaaa

SEQ ID NO: 84 - protein, 327 aa, Homo sapiens; identical to SEQ ID NO: 82
  transmembrane protease, serine 3 isoform 2

SEQ ID NO: 85 - DNA, 1359 bp, Homo sapiens
  transmembrane protease, serine 3 transcript variant  D
accgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatggtacatctgggtctctatgtggttctgcagctcttcctttgtttcaagaggatttgcaattgctcattgaagcattcttatgatggctgctttataatccttgtcagatattaataattccaactcctgattcatgttggtgttggcatcagttgattatcttttctcattaaaattgtgatgctcctaaaaaaaaaaaaaaaaaa

SEQ ID NO: 86 - protein, 344 aa, Homo sapiens
  transmembrane protease, serine 3 isoform 3
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNGTSGSLCGSAALPLFQEDLQLLIEAFL

SEQ ID NO: 87 - DNA, 1191 bp, Homo sapiens
  kallikrein hK15 transcript variant 1
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 88 - protein, 121 aa, Homo sapiens
  kallikrein hK15 isoform 1
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQ

SEQ ID NO: 89 - DNA, 1172 bp, Homo sapiens
  kallikrein hK15 transcript variant 2
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 90 - protein, 161 aa, Homo sapiens
  kallikrein hK15 isoform 2
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQG

SEQ ID NO: 91 - DNA, 1054 bp, Homo sapiens
  kallikrein hK15 transcript variant 3
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 92 - protein, 171 aa, Homo sapiens
  kallikrein hK15 isoform 3
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQGDSGGPLVCGGILQGIVSWGDVPCDNTTKPGVYTKVCHYLEWIRETMKRN

SEQ ID NO: 93 - DNA, 1309 bp, Homo sapiens
  kallikrein hK15 transcript variant 4
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 94 - protein, 256 aa, Homo sapiens
  kallikrein hK15 isoform 4
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 95 - DNA, 920 bp, Homo sapiens
  Mername-AA031 peptidase
cagacaggaggcgtctgtagagatatcatgaacttcaacttagctttgttttccagagactggagctaaactgggctttcaacatcatcatgaagtttatcctcctctgggccctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctcaaaaaaaaaaaaaaaaaaaaaaaaaaaa

SEQ ID NO: 96 - protein, 241 aa, Homo sapiens
  Mername-AA031 peptidase
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 97 - DNA, 2393 bp, Homo sapiens
  membrane-type mosaic serine protease
cgcccgggcaggttgagaagccaggggccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggcacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctccctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggaggtaagatccctgcagcaggacactgcacccagcaggctgggaacttcctcaggtggggaccctggaggagcacccagggtgtaggcagaggtcccctcagcgtccccatattcggggggtgttctggacagggtcaaatgtgatgcctggggtcaatcccagctgtctgtgtttctttccctgcttttcttccctcagaacagagctcagcgggttgaaaaagggtggacctacaggccaggcaggcagttgctgggcagatgttctcccagaagtatttttttgtgtaaggttgcaatggactttgaaaacgtttcagtttctgcagaggattttgtgatagtctttgttatcaagcatttatgcatgggaatccgctcttcatggcctttcccagctctgtttgttttagtctttttgattttctttttgttgttgttgttgtctttttttaaaaacacaagtgactccattttaactctgacaactttcacagctgtcaccagaatgctccctgagaactaccattctttccctttcccacttaaaatatttcatcagaacctcaccactatcataaaagagtataaagtaataaaataataaaaagcgaaaaaaaaaaaaaaaaaaaaaaaaaaaaaaaa

SEQ ID NO: 98 - protein, 581 aa, Homo Sapiens
  membrane-type mosaic serine protease
MERDSHGNASPARTPSAGASPAQASPAGTPPGRASPAQASPAQASPAGTPPGRASPAQASPAGTPPGRASPGRASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRHKEQRESCPKHAVRCDGVVDCKLKSDELGCVRFDWDKSLLKIYSGSSHQWLPICSSNWNDSYSEKTCRQLGFESAHRTTEVAHRDFANSFSILRYNSTIQESLHRSHCPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLHGGRDSCQGDSGGPLVCEQNNRWYLAGVTSWGTGCGQRNKPGVYTKVTEVLPWIYSKMEVRSLQQDTAPSRLGTSSGGDPGGAPRV

SEQ ID NO: 99 - protein, 148 aa, Homo sapiens
  mername-AA038 peptidase
CGKPKVVGKIYGGRDAAAGQWPWQASLLYWGSHLCGAVLIDSCWLVSTTHCFLNKSQAPKNYQVLLGNIQLYHQTQHTQKMSVHRIITHPDFEKLHPFGSDIAMLQLHLPMNFTSYIVPVCLPSRDMQLPSNVSCWITGWGMAILGGL

SEQ ID NO: 100 - DNA, 712 bp, Homo sapiens
  mername-AA128 peptidase
cacagagggctccagcgtgattgccactggttaatgacctgccacccccgcccccccaacctctggtgccgtccaaggactctgaccccagtgcagtgtctgtagggaagaggagccatggggcttcgggcaggccccatcctgcttctgctgctgtggctgctgccagaatgcggccactccaaggaggccgggaggattgtgggaggccaagacacccaggaaggacgctggccgtggcaggttggcctgtggttgacctcagtggggcatgtatgtgggggcttcctcatccacccacgctgggtgctcacagccgcccactgcttcctgagggtgactccggggggccgctggtctgccccatcaatgatacgtggatccaggccggcattgtgagctggggattcggctgtgcccggcctttccggcctggtgtctacacccaggtgctaagctacacagactggattcagagaaccctggctgaatctcactcaggcatgtctggggcccgcccaggtgccccaggatcccactcaggcacctccagatcccacccagtgctgctgcttgagctgttgaccgtatgcttgcttgggtccctgtgaaccatgagccatggagtccgggatcccctttctggtaggattgatggaatctaataataaaaactgtaggttttttatgtgaaaaaaaaaaaaaaaaaaaa

SEQ ID NO: 101 - protein, 146 aa, Homo sapiens
  mername-AA128 peptidase
MRPLQGGREDCGRPRHPGRTLAVAGWPVVDLSGACMWGLPHPPTLGAHSRPLLPEGDSGGPLVCPINDTWIQAGIVSWGFGCARPFRPGVYTQVLSYTDWIQRTLAESHSGMSGARPGAPGSHSGTSRSHPVLLLELLTVCLLGSL

SEQ ID NO: 102 - DNA, 800 bp, Homo sapiens
  cationic trypsin (Homo sapiens-type 1) (cationic)
accaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggacgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaaagcccccagtatctcttcagtctctataccaataaagtgaccctgttctc

SEQ ID NO: 103 - protein, 247 aa, Homo sapiens
  cationic trypsin (Homo sapiens-type 1) (cationic)
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 104 - DNA, 938 bp, Homo sapiens
  Neutrophil elastase
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaaaaaaaaaaaaaaaa

SEQ ID NO: 105 - protein, 267 aa, Homo sapiens
  Neutrophil elastase
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 106 - DNA, 3895 bp, Homo sapiens
  mannan-binding lectin-associated serine protease-3
attccggcacagggacacaaacaagctcacccaacaaagccaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaaaaaaaaaaaaaaaaaaa

SEQ ID NO: 107 - protein, 728 aa, Homo sapiens
  mannan-binding lectin-associated serine protease-3
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 108 - DNA, 924 bp, Homo sapiens
  cathepsin G
gcacagcagcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtactta

SEQ ID NO: 109 - protein, 255 aa, Homo sapiens
  cathepsin G
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 110 - DNA, 1001 bp, Homo sapiens
  myeloblastin (proteinase 3)
cgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 111 - protein, 256 aa, Homo sapiens
  myeloblastin (proteinase 3)
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 112 - DNA, 878 bp, Homo sapiens
  granzyme A
cagattttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaa

SEQ ID NO: 113 - protein, 262 aa, Homo sapiens
  granzyme A
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLTEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 114 - DNA, 947 bp, Homo sapiens
  granzyme M
ggctcggggccggggccagcacccacactgggtctccacagcggcatggaggcctgcgtgtcttcactgctggtgctggccctgggggccctgtcagtaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggatggcccagctgaggctggtgctggggctccacaccctggacagccccggtctcaccttccacatcaaggcagccatccagcaccctcgctacaagcccgtccctgccctggagaacgacctcgcgctgcttcagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaagggtgactcgggcgggcccctggtgtgtggcaaaggccgggtgttggccggagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctc

SEQ ID NO: 115 - protein, 257 aa, Homo sapiens
  granzyme M
MEACVSSLLVLALGALSVGSSFGTQIIGGREVIPHSRPYMASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLAGVLSFSSRVCTDIFKPPVATAVAPYVSWIRKVTGRSA

SEQ ID NO: 116 - DNA, 784 bp, Homo sapiens
  chymase (human-type)
agcatttgctcaggcagcctctctgggaagatgctgcttcttcctctccccctgctgctctttctcttgtgctccagagctgaagctggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcc

SEQ ID NO: 117 - protein, 247 aa, Homo sapiens
  chymase (human-type)
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 118 - DNA, 1194 bp, Homo sapiens; identical to SEQ ID NO: 47
  tryptase alpha (1)

SEQ ID NO: 119 - protein, 275 aa, Homo sapiens; identical to SEQ ID NO: 48
  tryptase alpha (1)

SEQ ID NO: 120 - DNA, 1074 bp, Homo sapiens
  granzyme K
gatcaacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactcaaaaaaaaaaaaaaaaaaaaaaaaaaaaa

SEQ ID NO: 121 - protein, 264 aa, Homo sapiens
  granzyme K
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 122 - DNA, 1047 bp, Homo sapiens
  granzyme H
ggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagctggagagaaaggccaagtggaccacagctgtgcggcctctcaggctacctagcagcaaggcccaggtgaagccagggcagctgtgcagtgtggctggctggggttatgtctcaatgagcactttagcaaccacactgcaggaagtgttgctgacagtgcagaaggactgccagtgtgaacgtctcttccatggcaattacagcagagccactgagatttgtgtgggggatccaaagaagacacagaccggtttcaagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcagggttgcaggactgtaataaatggatctctggtgtagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 123 - protein, 246 aa, Homo sapiens
  granzyme H
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 124 - DNA, 865 bp, Homo sapiens
  chymotrypsin B
ccctgccagcggcaccatggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggtcccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacac

SEQ ID NO: 125 - protein, 263 aa, Homo sapiens
  chymotrypsin B
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 126 - DNA, 952 bp, Homo sapiens
  pancreatic elastase
ttggtccaagcaagaaggcagtggtctactccatcggcaacatgctggtcctttatggacacagcacccaggaccttccggaaaccaatgcccgcgtagtcggagggactgaggccgggaggaattcctggccctctcagatttccctccagtaccggtctggaggttcccggtatcacacctgtggagggacccttatcagacagaactgggtgatgacagctgctcactgcgtggattaccagaagactttccgcgtggtggctggagaccataacctgagccagaatgatggcactgagcagtacgtgagtgtgcagaagatcgtggtgcatccatactggaacagcgataacgtggctgccggctatgacatcgccctgctgcgcctggcccagagcgttaccctcaatagctatgtccagctgggtgttctgccccaggagggagccatcctggctaacaacagtccctgctacatcacaggctggggcaagaccaagaccaatgggcagctggcccagaccctgcagcaggcttacctgccctctgtggactacgccatctgctccagctcctcctactggggctccactgtgaagaacaccatggtgtgtgctggtggagatggagttcgctctggatgccagggtgactctgggggccccctccattgcttggtgaatggcaagtattctgtccatggagtgaccagctttgtgtccagccggggctgtaatgtctccaggaagcctacagtcttcacccaggtctctgcttacatctcctggataaataatgtcatcgcctccaactgaacattttcctgagtccaacgaccttcccaaaatggttcttagatctgcaataggacttgcgatcaaaaagtaaaacacattctgaaagactattgagccattgatagaaaagcaaataaaactagatatacatt

SEQ ID NO: 127 - protein, 258 aa, Homo sapiens
  pancreatic elastase
MLVLYGHSTQDLPETNARVVGGTEAGRNSWPSQISLQYRSGGSRYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSVHGVTSFVSSRGCNVSRKPTVFTQVSAYISWINNVIASN

SEQ ID NO: 128 - DNA, 963 bp, Homo sapiens
  pancreatic endopeptidase E (A)
tcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattccaaaaaaaaaaaaaaaaaaaaaaaaaaaaaaaaaaaaaaaaaaaaaaaaaaaaaaaaaa

SEQ ID NO: 129 - protein, 270 aa, Homo sapiens
  pancreatic endopeptidase E (A)
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSGFGCNFIWKPTVFTRVSAFIDWIEETIASH

SEQ ID NO: 130 - DNA, 914 bp, Homo sapiens
  pancreatic elastase II (IIA)
ttttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgc

SEQ ID NO: 131 - protein, 269 aa, Homo sapiens
  pancreatic elastase II (IIA)
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 132 - DNA, 3696 bp, Homo sapiens
  Enteropeptidase
accagacagttcttaaattagcaagccttcaaaaccaaaaatggggtcgaaaagaggcatatcttctaggcatcattctctcagctcctatgaaatcatgtttgcagctctctttgccatattggtagtgctctgtgctggattaattgcagtatcctgcctgacaatcaaggaatcccaacgaggtgcagcacttggacagagtcatgaagccagagcgacatttaaaataacatccggagttacatataatcctaatttgcaagacaaactctcagtggatttcaaagttcttgcttttgaccttcagcaaatgatagatgagatctttctatcaagcaatctgaagaatgaatataagaactcaagagttttacaatttgaaaatggcagcattatagtcgtatttgaccttttctttgcccagtgggtgtcagatcaaaatgtaaaagaagaactgattcaaggccttgaagcaaataaatccagccaactggtcactttccatattgatttgaacagcgttgatatcctagacaagctaacaaccaccagtcatctggcaactccaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtttgtgatggaagatttttgttaactggatcatctgggtctttccaggctactcattatccaaaaccttctgaaacaagtgttgtctgccagtggatcatacgtgtaaaccaaggactttccattaaactgagcttcgatgattttaatacatattatacagatatattagatatttatgaaggtgtaggatcaagcaagattttaagagcttctatttgggaaactaatcctggcacaataagaattttttccaaccaagttactgccacctttcttatagaatctgatgaaagtgattatgttggctttaatgcaacatatactgcatttaacagcagtgagcttaataattatgagaaaattaattgtaactttgaggatggcttttgtttctgggtccaggatctaaatgatgataatgaatgggaaaggattcagggaagcaccttttctccttttactggacccaattttgaccacacttttggcaatgcttcaggattttacatttctaccccaactggaccaggagggagacaagaacgagtggggcttttaagcctccctttggaccccactttggagccagcttgccttagtttctggtatcatatgtatggtgaaaatgtccataaattaagcattaatatcagcaatgaccaaaatatggagaagacagttttccaaaaggaaggaaattatggagacaattggaattatggacaagtaaccctaaatgaaacagttaaatttaaggttgcttttaatgcttttaaaaacaagatcctgagtgatattgcgttggatgacattagcctaacatatgggatttgcaatgggagtctttatccagaaccaactttggtgccaactcctccaccagaacttcctacggactgtggaggaccttttgagctgtgggagccaaatacaacattcagttctacgaactttccaaacagctaccctaatctggctttctgtgtttggattttaaatgcacaaaaaggaaagaatatacaacttcattttcaagaatttgacttagaaaatattaacgatgtagttgaaataagagatggtgaagaagctgattccttgctcttagctgtgtacacagggcctggcccagtaaaggatgtgttctctaccaccaacagaatgactgtgcttctcatcactaacgatgtgttggcaagaggagggtttaaagcaaactttactactggctatcacttggggattccagagccatgcaaggcagaccattttcaatgtaaaaatggagagtgtgttccactggtgaatctctgtgacggtcatctgcactgtgaggatggctcagatgaagcagattgtgtgcgttttttcaatggcacaacgaacaacaatggtttagtgcggttcagaatccagagcatatggcatacagcttgtgctgagaactggaccacccagatttcaaatgatgtttgtcaactgctgggactagggagtggaaactcatcaaagccaatcttctctaccgatggtggaccatttgtcaaattaaacacagcacctgatggccacttaatactaacacccagtcaacagtgtttacaggattccttgattcggttacagtgtaaccataaatcttgtggaaaaaaactggcagctcaagacatcaccccaaagattgttggaggaagtaatgccaaagaaggggcctggccctgggttgtgggtctgtattatggcggccgactgctctgcggcgcatctctcgtcagcagtgactggctggtgtccgccgcacactgcgtgtatgggagaaacttagagccatccaagtggacagcaatcctaggcctgcatatgaaatcaaatctgacctctcctcaaacagtccctcgattaatagatgaaattgtcataaaccctcattacaataggcgaagaaaggacaacgacattgccatgatgcatctggaatttaaagtgaattacacagattacatacaacctatttgtttaccggaagaaaatcaagtttttcctccaggaagaaattgttctattgctggttgggggacggttgtatatcaaggtactactgcaaacatattgcaagaagctgatgttcctcttctatcaaatgagagatgccaacagcagatgccagaatataacattactgaaaatatgatatgtgcaggctatgaagaaggaggaatagattcttgtcagggggattcaggaggaccattaatgtgccaagaaaacaacaggtggttccttgctggtgtgacctcatttggatacaagtgtgccctgcctaatcgccccggagtgtatgccagggtctcaaggtttaccgaatggatacaaagttttctacattagcgcatttcttaaactaaacaggaaagtcgcattattttcccattctactctagaaagcatggaaattaagtgtttcgtacaaaaattttaaaaagttaccaaaggtttttattcttacctatgtcaatgaaatgctagggggccagggaaacaaaattttaaaaataataaaattcaccatagcaatacagaataactttaaaataccattaaatacatttgtatttcattgtgaacaggtatttcttcacagatctcatttttaaaattcttaatgattatttttattacttactgttgtttaaagggatgttattttaaagcatataccatacacttaagaaatttgagcagaatttaaaaaagaaagaaaataaattgtttttcccaaagtatgtcactgttggaaataaactgccataaattttctagttccagtttagtttgctgctattagcagaaactcaattgtttctctgtcttttctatcaaaattttcaacatatgcataaccttagtattttcccaaccaatagaaactatttattgtaagcttatgtcacaggcctggactaaattgattttacgttcctctt

SEQ ID NO: 133 - protein, 1019 aa, Homo sapiens
  Enteropeptidase
MGSKRGISSRHHSLSSYEIMFAALFAILVVLCAGLIAVSCLTIKESQRGAALGQSHEARATFKITSGVTYNPNLQDKLSVDFKVLAFDLQQMIDEIFLSSNLKNEYKNSRVLQFENGSIIVVFDLFFAQWVSDQNVKEELIQGLEANKSSQLVTFHIDLNSVDILDKLTTTSHLATPGNVSIECLPGSSPCTDALTCIKADLFCDGEVNCPDGSDEDNKMCATVCDGRFLLTGSSGSFQATHYPKPSETSVVCQWIIRVNQGLSIKLSFDDFNTYYTDILDIYEGVGSSKILRASIWETNPGTIRIFSNQVTATFLIESDESDYVGFNATYTAFNSSELNNYEKINCNFEDGFCFWVQDLNDDNEWERIQGSTFSPFTGPNFDHTFGNASGFYISTPTGPGGRQERVGLLSLPLDPTLEPACLSFWYHMYGENVHKLSINISNDQNMEKTVFQKEGNYGDNWNYGQVTLNETVKFKVAFNAFKNKILSDIALDDISLTYGICNGSLYPEPTLVPTPPPELPTDCGGPFELWEPNTTFSSTNFPNSYPNLAFCVWILNAQKGKNIQLHFQEFDLENINDVVEIRDGEEADSLLLAVYTGPGPVKDVFSTTNRMTVLLITNDVLARGGFKANFTTGYHLGIPEPCKADHFQCKNGECVPLVNLCDGHLHCEDGSDEADCVRFFNGTTNNNGLVRFRIQSIWHTACAENWTTQISNDVCQLLGLGSGNSSKPIFSTDGGPFVKLNTAPDGHLILTPSQQCLQDSLIRLQCNHKSCGKKLAAQDITPKIVGGSNAKEGAWPWVVGLYYGGRLLCGASLVSSDWLVSAAHCVYGRNLEPSKWTAILGLHMKSNLTSPQTVPRLIDEIVINPHYNRRRKDNDIAMMHLEFKVNYTDYIQPICLPEENQVFPPGRNCSIAGWGTVVYQGTTANILQEADVPLLSNERCQQQMPEYNITENMICAGYEEGGIDSCQGDSGGPLMCQENNRWFLAGVTSFGYKCALPNRPGVYARVSRFTEWIQSFLH

SEQ ID NO: 134 - DNA, 917 bp, Homo sapiens
  chymotrypsin C
cagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggccacctgaaaaaaaaaaaaaaaaaa

SEQ ID NO: 135 - protein, 268 aa, Homo sapiens [sequence omitted]

SEQ ID NO: 136 - DNA, 1938 bp, Homo sapoens
  Prostasin
gactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcac

SEQ ID NO: 137 - protein, 343 aa, Homo sapiens
  Prostasin
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 138 - DNA, 874 bp, Homo sapiens
  kallikrein 1
agttcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 139 - protein, 262 aa, Homo sapiens
  kallikrein 1
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 140 - DNA, 2855 bp, Homo sapiens
  kallikrein hK2 transcript variant 1
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaa

SEQ ID NO: 141 - protein, 261 aa, Homo sapiens
  kallikrein hK2 isoform 1
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 142 - DNA, 2892 bp, Homo sapiens
  kallikrein hK2 transcript variant 2
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaa

SEQ ID NO: 143 - protein, 223 aa, Homo sapiens
  kallikrein hK2 isoform 2
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKG

SEQ ID NO: 144 - DNA, 2879 bp, Homo sapiens
  kallikrein hK2 transcript variant 3
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagtgagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaa

SEQ ID NO: 145 - protein, 164 aa, Homo sapiens
  kallikrein hK2 isoform 3
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEE

SEQ ID NO: 146 - DNA, 1464 bp, Homo sapiens
  kallikrein 3 transcript variant 1
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 147 - protein, 261 aa, Homo sapiens
  kallikrein 3 isoform 1
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 148 - DNA, 1906 bp, Homo sapiens
  kallikrein 3 transcript variant 3
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 149 - protein, 238 aa, Homo sapiens
  kallikrein 3 isoform 3
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 150 - DNA, 1335 bp, Homo sapiens
  kallikrein 3 transcript variant 4
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 151 - protein, 218 aa, Homo sapiens
  kallikrein 3 isoform 4
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 152 - DNA, 1341 bp, Homo sapiens
  kallikrein 3 transcript variant 5
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 153 - protein, 220 aa, Homo sapiens
  kallikrein 3 isoform 5
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 154 - DNA, 555 bp, Homo sapiens
  kallikrein 3 transcript variant 6
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagt

SEQ ID NO: 155 - protein, 69 aa, Homo sapiens
  kallikrein 3 isoform 6
MWVPVVFLTLSVTWIGAAPLILSRIVGGWECEKHSQPWQVLVASRGRAVCGGVLVHPQWVLTAAHCIRK

SEQ ID NO: 156 - DNA, 807 bp, Homo sapiens
  Mesotrypsin
acactctaccaccatgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctc

SEQ ID NO: 157 - protein, 247 aa, Homo sapiens
  Mesotrypsin
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 158 - DNA, 1055 bp, Homo sapiens
  pancreatic endopeptidase E form B (B)
acctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagcggaagcttctaccacacctgtggcggtagcctcatcgcccccgactgggttgtgactgccggccactgcatctcgagctcccggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggagaccatagcaagccactagaaccaaggcccagctggcagtgctgatcgatcccacatcctgaataaagaataaagatctctcagaaaattccaaaaaaaaaaaaaaaaaaaaaaaaaaaaaaaaaaaaaaaaaaaaaaaaaaaaaa

SEQ ID NO: 159 - protein, 270 aa, Homo sapiens
  pancreatic endopeptidase E form B (B)
MMLRLLSSLLLVAVASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 160 - DNA, 941 bp, Homo sapiens
  pancreatic elastase II form B (Homos sapiens) (IIB)
cttacagaactcccacggacacaccatgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccggttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaaccaaaagaagtccctgggactgtttcagacttggaaaggtcacagaaggaaaataatattatataaagtgacaactatgcaaatcacaaaaaaaaaaaaaaaaaaa

SEQ ID NO: 161 - protein, 269 aa, Homo sapiens
  pancreatic elastase II form B (Homos sapiens) (IIB)
MIRTLLLSTLVAGALSCGVSTYAPDMSRMLGGEEARPNSWPWQVSLQYSSNGQWYHTCGGSLIANSWVLTAAHCISSSGIYRVMLGQHNLYVAESGSLAVSVSKIVVHKDWNSDQVSKGNDIALLKLANPVSLTDKIQLACLPPAGTILPNNYPCYVTGWGRLQTNGALPDDLKQGRLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 162 - DNA, 2048 bp, Homo sapiens
  coagulation factor XIIa
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgaggaactcaataaagtgctttgaaaatgctgag

SEQ ID NO: 163 - protein, 615 aa, Homo sapiens
  coagulation factor XIIa
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 164 - DNA, 2245 bp, Homo sapiens
  plasma kallikrein
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaacggaatgtggcgtttggtgggcatcacaagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaagacacagtgcactcagagctgctgaggacaatgtctgctgaagcccgctttcagcacgccgtaaccaggggctgacaatgcgaggtcgcaactgagatctccatgactgtgtgttgtgaaataaaatggtgaaagatc

SEQ ID NO: 165 - protein, 638 aa, Homo sapiens
  plasma kallikrein
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTNNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 166 - DNA, 2217 bp, Homo sapiens
  coagulation factor XIa transcript variant 1
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtcc

SEQ ID NO: 167 - protein, 625 aa, Homo sapiens
  coagulation factor XIa isoform 1
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 168 - DNA, 2055 bp, Homo sapiens
  coagulation factor XIa transcript variant  2
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtcc

SEQ ID NO: 169 - protein, 571 aa, Homo sapiens
  coagulation factor XIa isoform 2
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 170 - DNA, 2804 bp, Homo sapiens
  coagulation factor IXa
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 171 - protein, 461 aa, Homo sapiens
  coagulation factor IXa
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 172 - DNA, 2478 bp, Homo sapiens
  coagulation factor VIIa transcript variant 1
agtcccatggggaatgtcaacaggcaggggcagcactgcagagatttcatcatggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccaccc

SEQ ID NO: 173 - protein, 466 aa, Homo sapiens
  coagulation factor VIIa isoform 1
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 174 - DNA, 2412 bp, Homo sapiens
  coagulation factor VIIa transcript variant 2
agtcccatggggaatgtcaacaggcaggggcagcactgcagagatttcatcatggtctcccaggccctcaggctcctctgccttctgcttgggcttcagggctgcctggctgcagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccaccc

SEQ ID NO: 175 - protein, 444 aa, Homo sapiens
  coagulation factor VIIa isoform 2
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 176 - DNA, 1502 bp, Homo sapiens
  coagulation factor Xa
cagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaaccattctgagcgagttctacatcctaacggcagcccactgtctctaccaagccaagagattcaaggtgagggtaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactc

SEQ ID NO: 177 - protein, 488 aa, Homo sapiens
  coagulation factor Xa
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 178 - DNA, 1997 bp, Homo sapiens
  Thrombin
aattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctagagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcacaaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtaggggccactcatattctgggctcctggaaccaatcccgtgaaagaattatttttgtgtttctaaaactatggttcccaataaaagtgactctcagcgg

SEQ ID NO: 179 - protein, 622 aa, Homo sapiens
  Thrombin
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 180 - DNA, 1843 bp, Homo sapiens
  protein C (activated)
ctgcaggggggggggggggggggggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaaaaaaaaaaaaaaaaaaaaaaaaaaaaaaaaaaaaaaaacccccccccgccccccccccctgcag

SEQ ID NO: 181 - protein, 461 aa, Homo sapiens
  protein C (activated)
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 182 - DNA, 1388 bp, Homo sapiens
  Acrosin
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctgtgcaagagagatatgtggagaaaatcatcattcatgaaaaatacaactctgcgacagagggaaatgacattgccctcgtggagatcacccctcccatttcgtgtgggcgcttcattgggccgggctgcctgccccacttgaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagggagacagcggcgggcctctcatgtgcaaagacagcaaggaaagcgcctatgtggtcgtgggaatcacaagctggggggtaggctgtgcccgtgccaagcgccccggaatctacacggccacctggccttatctgaactggatcgcctccaagattggttctaacgctttgcgtatgattcaatcggccacccctccaccgcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatataaaaaaaaaaaaaaa

SEQ ID NO: 183 - protein, 421 aa, Homo sapiens
  Acrosin
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPVQERYVEKIIIHEKYNSATEGNDIALVEITPPISCGRFIGPGCLPHLKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 184 - DNA, 2363 bp, Homo sapiens
  Hepsin transcript variant 1
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtctccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgatt

SEQ ID NO: 185 - protein, 417 aa, Homo sapiens
  Hepsin
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 186 - DNA, 1783 bp, Homo sapiens
  Hepsin transcript variant 2
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgatt

SEQ ID NO: 187 - protein, 417 aa, Homo sapiens; identical to SEQ ID NO: 185
  Hepsin

SEQ ID NO: 188 - DNA, 2038 bp, Homo sapiens
  hepatocyte growth factor activator
gccatggggcgctgggcctgggtccccagcccctggcccccaccggggctgggccccttcctcctcctcctcctgctgctgctgctgctgccacgggggttccagccccagcctggcgggaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaagcactcaccgaggacgggaggccctgcaggttccccttccgctacgggggccgcatgctgcatgcctgcacttcggagggcagtgcacacaggaagtggtgtgccacaactcacaactacgaccgggacagggcctggggctactgtgtggaggccaccccgcctccagggggcccagctgccctggatccctgtgcctccggcccctgcctcaatggaggctcctgctccaatacccaggacccccagtcctatcactgcagctgcccccgggccttcaccggcaaggactgcggcacagagaaatgctttgatgagacccgctacgagtacctggaggggggcgaccgctgggcccgcgtgcgccagggccacgtggaacagtgcgagtgcttcgggggccggacctggtgcgaaggcacccgacatacagcttgtctgagcagcccttgcctgaacgggggcacctgccacctgatcgtggccaccgggaccaccgtgtgtgcctgcccaccaggcttcgctggacggctctgcaacatcgagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggaatccggacaatgacgagaggccctggtgctacgtggtgaaggacagcgcgctctcctgggagtactgccgcctggaggcctgcgaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcgtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagaacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccggatacggcctcccaggcggcttgtggctccctcctgaccctccagcgggacaccctggttcccaccattccctgccttgctgacaataaagatatttccaagaa

SEQ ID NO: 189 - protein, 655 aa, Homo sapiens
  hepatocyte growth factor activator
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 190 - DNA, 2360 bp, Homo sapiens
  u-plasminogen activator (uPA)
acagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgaaaaaaaaaaaaaaa

SEQ ID NO: 191 - protein, 431 aa, Homo sapiens
  u-plasminogen activator (uPA)
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 192 - DNA, 2653 bp, Homo sapiens
  t-plasminogen activator (tPA) transcript variant 1
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 193 - protein, 562 aa, Homo sapiens
  t-plasminogen activator (tPA) isoform 1
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 194 - DNA, 2160 bp, Homo sapiens
  t-plasminogen activator (tPA) transcript variant 2
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaaaaaaaaaaaaaaaa

SEQ ID NO: 195 - protein, 291 aa, Homo sapiens
  t-plasminogen activator (tPA) isoform 2
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRTGRSVSSPATASMRPCLLSIRSG

SEQ ID NO: 196 - DNA, 2534 bp, Homo sapiens
  t-plasminogen activator (tPA) transcript variant 3
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaaaaaaaaaaaaaa

SEQ ID NO: 197 - protein, 516 aa, Homo sapiens
  t-plasminogen activator (tPA) isoform 3
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 198 - DNA, 2732 bp, Homo sapiens
  Plasmin
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgcgacatcccccgctgcacaacacctccaccatcttctggtcccacctaccagtgtctgaagggaacaggtgaaaactatcgcgggaatgtggctgttaccgtttccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtgggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggtttt

SEQ ID NO: 199 - protein, 810 aa, Homo sapiens
  Plasmin
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 200 - DNA, 1527 bp, Homo sapiens
  Neurosin transcript variant A
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaaaaaaaaa

SEQ ID NO: 201 - protein, 244 aa, Homo sapiens
  Neurosin isoform A
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 202 - DNA, 1527 bp, Homo sapiens
  Neurosin transcript variant B
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 203 - protein, 244 aa, Homo sapiens; identical to SEQ ID NO: 201
  Neurosin isoform A preprotein

SEQ ID NO: 204 - DNA, 1495 bp, Homo sapiens
  Neurosin transcript variant C
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaaaaaaaaa

SEQ ID NO: 205 - protein, 137 aa, Homo sapiens
  Neurosin isoform B
MLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 206 - DNA, 1386 bp, Homo sapiens
  Neurosin transcript variant D
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaaaaaaaaa

SEQ ID NO: 207 - protein, 40 aa, Homo sapiens
  Neurosin isoform C
MKKLMVVLSLIAAGIFRSSWGSITFGKGRVPRSRVLLSGL

SEQ ID NO: 208 - DNA, 3351 bp, Homo sapiens
  Neurotrypsin
gcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacagttgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtgc

SEQ ID NO: 209 - protein, 875 aa, Homo sapiens
  Neurotrypsin
MTLARFVLALMLGALPEVVGFDSVLNDSLHHSHRHSPPAGPHYPYYLPTQQRPPTTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 210 - DNA, 1165 bp, Homo sapiens
  tryptase beta 2 (I)
agaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatca

SEQ ID NO: 211 - protein, 275 aa, Homo sapiens
  tryptase beta 2 (I)
MLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 212 - DNA, 1013 bp, Homo sapiens
  Neuropsin transcript variant 1
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 213 - protein, 260 aa, Homo sapiens
  Neuropsin isoform 1
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 214 - DNA, 1148 bp, Homo sapiens
  Neuropsin transcript variant 2
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 215 - protein, 305 aa, Homo sapiens
  Neuropsin isoform 2
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 216 - DNA, 590 bp, Homo sapiens
  Neuropsin transcript variant 3
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 217 - protein, 119 aa, Homo sapiens
  Neuropsin isoform 3
MGRPRPRAAKTWMFLLLLGGAWAENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 218 - DNA, 456 bp, Homo sapiens
  Neuropsin transcript variant 4
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 219 - protein, 32 aa, Homo sapiens
  Neuropsin isoform 4
MGRPRPRAAKTWMFLLLLGGAWAGRFWRPPGV

SEQ ID NO: 220 - DNA, 1580 bp, Homo sapiens
  kallikrein hK10 transcript variant 1
catcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 221 - protein, 276 aa, Homo sapiens
  kallikrein hK10
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVLGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 222 - DNA, 1443 bp, Homo sapiens
  kallikrein hK10 transcript variant 2
accagcggcagaccacaggcagggcagaggcacgtctgggtcccctccctccttcctatcggcgactcccaggatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 223 - protein, 276 aa, Homo sapiens; identical to SEQ ID NO: 221
  kallikrein hK10

SEQ ID NO: 224 - DNA, 3226 bp, Homo sapiens
  Epitheliasin
cgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcacctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagcaaaaaaaaaaaaaaaaaaaaaaaaaaaaaaa

SEQ ID NO: 225 - protein, 492 aa, Homo sapiens
  Epitheliasin
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQMYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 226 - DNA, 1280 bp, Homo sapiens
  Prostase
atggccacagcaggaaatccctggggctggttcctggggtacctcatccttggtgtcgcaggatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgc

SEQ ID NO: 227 - protein, 254 aa, Homo sapiens
  Prostase
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 228 - DNA, 1391 bp, Homo sapiens
  Brain serine proteinase 2
acacaccctgacccgcatcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccacatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgccccgggccccagcgcttttgtgtatataaatgttaatgatttttataggtatttgtaaccctgcccacatatcttatttattcctccaatttcaataaattatttattctccagtgaaaaa

SEQ ID NO: 229 - protein, 317 aa, Homo sapiens
  Brain serine proteinase 2
MVVSGAPPALGGGCLGTFTSLLLLASTAILNAARIPVPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 230 - DNA, 1184 bp, Homo sapiens
  Chymopasin
atctgccacgatgttgctgctcagcctgaccctaagcctggttctcctcggctcctcctggggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgcattcatgtctgtcttcctggctcaggagaaagaagaggctgttgagggtccgactccctacttggacttctggcacagaaggggctgagtgactccttgagtagcagtggctcttcctagagtagccatgccgaggccggggcccccacccctcctccagggcaaccccttggtcctacagcaagaagccagaactgttggaatgaatggcagccctccctggagaggcagcctgtttactgaatacagaggatacgtttacaaactgaatacgcataataaataactgcacattctccatccaaaaaaaaaaaaaaaa

SEQ ID NO: 231 - protein, 264 aa, Homo sapiens
  Chymopasin
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGIVSWGTKNCNVRAPAVYTRVSKFSTWINQVIAYN

SEQ ID NO: 232 - DNA, 1207 bp, Homo sapiens
  kallikrein 11 transcript variant 1
ggagtgcaggcttggaaagcaggagagctcagcctacgtctttaatcctcctgcccaccccttggattctgtctccactgggactcaagagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaaaaaaaaaaaaaaaa

SEQ ID NO: 233 - protein, 250 aa, Homo sapiens
  kallikrein 11 isoform 1
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 234 - DNA, 1289 bp, Homo sapiens
  kallikrein 11 transcript variant 2
ctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaaaaaaaaaaaaaaaa

SEQ ID NO: 235 - protein, 282 aa, Homo sapiens
  kallikrein 11 isoform 2
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 236 - DNA, 802 bp, Homo sapiens
  anionic trypsin (II)
accaccatgaatctacttctgatccttacctttgttgcagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 237 - protein, 247 aa, Homo sapiens
  anionic trypsin (II)
MNLLLILTFVAAAVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 238 - DNA, 1475 bp, Homo sapiens
  LOC144757 peptidase
acctgccgccatcttgctcaccagcctccaaaatgcggctggggctcctgagcgtggcgctgttgtttgtggggagctctcacttatactcagaccactactcgccctctggaaggcacaggctcggcccctcgccggaaccggcggctagttcccagcaggctgaggccgtccgcaagaggctccggcggcggagggagggaggggcgcatgcaaaggattgtggaacagcaccgcttaaggatgtgttgcaagggtctcggattatagggggcaccgaagcacaagctggcgcatggccgtgggtggtgagcctgcagattaaatatggccgtgttcttgttcatgtatgtgggggaaccctagtgagagagaggtgggtcctcacagctgcccactgcactaaagacgctagcgatcctttaatgtggacagctgtgattggaactaataatatacatggacgctatcctcataccaagaagataaaaattaaagcaatcattattcatccaaacttcattttggaatcttatgtaaatgatattgcactttttcacttaaaaaaagcagtgaggtataatgactatattcagcctatttgcctaccttttgatgttttccaaatcctggacggaaacacaaagtgttttataagtggctggggaagaacaaaagaagaaggtaacgctacaaatattttacaagatgcagaagtgcattatatttctcgagagatgtgtaattctgagaggagttatgggggaataattcctaacacttcattttgtgcaggtgatgaagatggagcttttgatacttgcaggggtgacagtgggggaccattaatgtgctacttaccagaatataaaagattttttgtaatgggaattaccagttacggacatggctgtggtcgaagaggttttcctggtgtctatattgggccatccttctaccaaaagtggctgacagagcatttcttccatgcaagcactcaaggcatacttactataaatattttacgtggccagatcctcatagctttatgttttgtcatcttactagcaacaacataaagaaattctgaaggctttcatatctttattttgcattgtgtccctttctatgttctatataatgaacatcatttattcttctagcaattaattgcctacattagagatttcatgtgaacattttatgggctataagtattgtgacagatatacaattgtaattttggcactgaatcacatgtctccttgaaatatcttgattattttataatcataattctgtatctggaatactcatagagtttgtacaaaatattcagttaaacatatatgtgtataaatgccaaataatagtttataattaaaatgaaagctgtcatttggttaaattaataaaaattctttcttagattttattctaaaaaaaaaaaaaaaaaaagaaaaaaaaaaaaaaaa

SEQ ID NO: 239 - protein, 348 aa, Homo sapiens
  LOC144757 peptidase
MRLGLLSVALLFVGSSHLYSDHYSPSGRHRLGPSPEPAASSQQAEAVRKRLRRRREGGAHAKDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRGDSGGPLMCYLPEYKRFFVMGITSYGHGCGRRGFPGVYIGPSFYQKWLTEHFFHASTQGILTINILRGQILIALCFVILLATT

SEQ ID NO: 240 - DNA, 1164 bp, Homo sapiens
  Mername-AA169 peptidase
atgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatggttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaa

SEQ ID NO: 241 - protein, 387 aa, Homo sapiens
  Mername-AA169 peptidase
MIAVLIVLSLTVVAVTIGLLVHFLVFDQKKEYYHGSFKILDPQINNNFGQSNTYQLKDLRETTENLVDEIFIDSAWKKNYIKNQVVRLTPEEDGVKVDVIMVFQFPSTEQRAVREKKIQSILNQKIRNLRALPINASSVQVNGCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 242 - protein, 431 aa, Rattus norvegicus
  Mername-AA171 peptidase
MARGQPRRSEEPWTALRNRTECKTKIKLTKCGKITLGILTAVIAAVVIGLIAYFAACGKTPFYYHVSFKVNNIDYDSKFAKPYSQEYMDLNKRIVSLMNETFHESKLRKQYVKAHTVQVSKAKGKVVIHGVLKFKSCYKNNVEKFWDSVETILYQKLKSQTRLLIDSSSFKFSDIAMPIAEDLLNTCCGRRTITPGGHKVAGGQDAEEGEWPWQASLQQNNVHRCGATLISNSWLITAAHCFVRSANPKDWKVSFGFLLSKPQAQRAVKSIVIHENYSYPAHNNDIAVVRLSSPVLYENNIRRACLPEATQKFPPNSDVVVTGWGTLKSDGDSPNILQKGRVKIIDNKTCNSGKAYGGVITPGMLCAGFLEGRVDACQGDSGGPLVSEDSKGIWFLAGIVSWGDECALPNKPGVYTRVTHYRDWISSKTGL

SEQ ID NO: 243 - protein, 247 aa, Homo sapiens
  Mername-AA174 peptidase
MNPLLILAFVGAAVAVPFDDDDKIVGGYTCEENSVPYQVSLNSGSHFCGGSLISEQWVVSAGHCYKPHIQVRLGEHNIEVLEGNEQFINAAKIIRHPKYNRITLNNDIMLIKLSTPAVINAHVSTISLPTAPPAAGTECLISGWGNTLSSGADYPDELQCLDAPVLTQAKCKASYPLKITSKMFCVGFLEGGKDSCQGDSGGPVVCNGQLQGIVSWGYGCAQKRRPGVYTKVYNYVDWIKDTIAANS

SEQ ID NO: 244 - DNA, 1099 bp, Homo sapiens
  Mername-AA175 peptidase
gcacagcccagggccatgctcctgttctcagtgttgctgctcctgtccctggtcacgggaactcagctcggtccacggactcctctcccagaggctggagtggctatcctaggcagggctaggggagcccaccgccctcagccccgtcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagtgccaatggtcatcatggactgggaggagtgttcaaagatgtttccaaaacttaccaaaaatatgctgtgtgccggatacaagaatgagagctatgatgcctgcaagggtgacagtggggggcctctggtctgcaccccagagcctggtgagaagtggtaccaggtgggcatcatcagctggggaaagagctgtggagagaagaacaccccagggatatacacctcgttggtgaactacaacctctggatcgagaaagtgacccagctagagggcaggcccttcaatgcagagaaaaggaggacttctgtcaaacagaaacctatgggctccccagtctcgggagtcccagagccaggcagccccagatcctggctcctgctctgtcccctgtcccatgtgttgttcagagctattttgtactgataataaaatagaggctattctttca

SEQ ID NO: 245 - protein, 352 aa, Homo sapiens
  Mername-AA175 peptidase
MLLFSVLLLLSLVTGTQLGPRTPLPEAGVAILGRARGAHRPQPRHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKVPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 246 - DNA, 1927 bp, Homo sapiens
  stratum corneum chymotryptic enzyme transcript variant 1
tgccagcccaagtcggaacttggatcacatcagatcctctcgagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtctgaaga

SEQ ID NO: 247 - protein, 253 aa, Homo sapiens
  stratum corneum chymotryptic enzyme transcript variant 1
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 248 - DNA, 1927 bp, Homo sapiens
  stratum corneum chymotryptic enzyme transcript variant 2
ggagagggtgatgctggctccaagcctgactctgctctcgagagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtctgaaga

SEQ ID NO: 249 - protein, 253 aa, Homo sapiens; identical to SEQ ID NO: 247
  stratum corneum chymotryptic enzyme

SEQ ID NO: 250 - DNA, 2800 bp, Homo sapiens
  trypsin-like enzyme, respiratory
atttgagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctccagagaactatatgaatgttgcatagtactgtggctgtgtaacagaagaaacacactaaactaattacaaagttaacaatttcattacagttgtgctaaatgcccgtagtgagaagaacaggaaccttgagcatgtatagtagaggaacctgcacaggtctgatgggtcagaggggtcttctctgggtttcactgaggatgagaagtaagcaaactgtggaaacatgcaaaggaaaaagtgatagaataatattcaagacaaaaagaacagtatgaggcaagagaaataatatgtatttaaaatttttggttactcaatatcttatacttagtatgagtcctaaaattaaaaatgtgaaactgttgtactatacgtataacctaaccttaattattctgtaagaacatgcttccataggaaatagtggataattttcagctatttaaggcaaaagctaaaatagttcactcctcaactgagacccaaagaattatagatatttttcatgatgacccatgaaaaatatcactcatctacataaaggagagactatatctattttatagagaagctaagaaatatacctacacaaacttgtcaggtgctttacaactacatagtactttttaacaacaaaataataattttaagaatgaaaaatttaatcatcgggaagaacgtcccactacagacttcctatcactggcagttatatttttgagcgtaaaagggtcgtcaaacgctaaatctaagtaacgaattgaaagtttaaagagggggaagagttggtttgcaaaggaaaagtttaaatagcttaatatcaatagaatgatcctgaagacagaaaaaactttgtcactcttcctctctcattttctttctctctctctccccttctcatacacatgcctcccccaccaaagaatataatgtaaattaaatccactaaaatgtaatggcatgaaaatctctgtagtctgaatcactaatattcctgagtttttatgagctcctagtacagctaaagtttgcctatgcatgatcatctatgcgtcagagcttcctccttctacaagctaactccctgcatctgggcatcaggactgctccatacatttgctgaaaacttcttgtatttcctgatgtaaaattgtgcaaacacctacaataaagccatctacttttagggaaagggagttgaaaatgcaaccaactcttggcgaactgtacaaacaaatctttgctatactttatttcaaataaattctttttaaaataaaaaaaaaaaaaaaaaaa

SEQ ID NO: 251 - protein, 418 aa, Homo sapiens
  trypsin-like enzyme, respiratory
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 252 - DNA, 3149 bp, Homo sapiens
  Matripase
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 253 - protein, 855 aa, Homo sapiens [sequence omitted]

SEQ ID NO: 254 - DNA, 1258 bp, Homo sapiens
  kallikrein hK13
tcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 255 - protein, 277 aa, Homo sapiens
  kallikrein hK13
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 256 - DNA, 1438 bp, Homo sapiens
  kallikrein hK9
catggaggaggaaggagatggcatggcttaccataaagaagcactggacgccgggtgcacgttccaggatccaggtgcccaggggtcatgaagctgggactcctctgtgctctgctctctctgctggcagggcatggctgggcagacacccgtgccatcggggccgaggaatgtcgccccaactcccagccttggcaggccggcctcttccaccttactcggctcttctgtggggcgaccctcatcagtgaccgctggctgctcacagctgcccactgccgcaagccgtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactgagcccgcgcgccacgggggcaccttggaagaccaagagaggccgaagggcacggggtagggggttctcgtagggtcccagcctcaatggttcccgccctggacctccagctgccctgactcccctctggacactaagactccgcccctgaggctccgccccctcacgaggtcaagcaagacacagtcgcgccccctcggaacggagcagggacacgcccttcagagcccgtctctatgacgtcaccgacagccatcacctccttcttggaacagcacagcctgtggctccgccccaaggaaccacttacacaaaatagctccgcccctcggaactttgcccagtgggacttcccctcgggactccaccccttgtggccccgcctccttcaccagagatctcgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctca

SEQ ID NO: 257 - protein, 250 aa, Homo sapiens
  kallikrein hK9
MKLGLLCALLSLLAGHGWADTRAIGAEECRPNSQPWQAGLFHLTRLFCGATLISDRWLLTAAHCRKPYLWVRLGEHHLWKWEGPEQLFRVTDFFPHPGFNKDLSANDHNDDIMLIRLPRQARLSPAVQPLNLSQTCVSPGMQCLISGWGAVSSPKALFPVTLQCANISILENKLCHWAYPGHISDSMLCAGLWEGGRGSCQGDSGGPLVCNGTLAGVVSGGAEPCSRPRRPAVYTSVCHYLDWIQEIMEN

SEQ ID NO: 258 - DNA, 3212 bp, Homo sapiens
  Mername-AA035 peptidase
cttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatcaaaaaaaaaaaaaaaaaaaaa

SEQ ID NO: 259 - protein, 811 aa, Homo sapiens
  Mername-AA035 peptidase
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 260 - DNA, 3750 bp, Homo sapiens
  umbilical vein proteinase
gcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcacaaaaaaaaaaaaaaaaaaaa

SEQ ID NO: 261 - protein, 383 aa, Homo sapiens
  umbilical vein proteinase
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 262 - protein, 26 aa, Homo sapiens
  LCLP proteinase (LCLP (N-terminus))
IIGGTESKPDSRPYMALLQIVEPAVH

SEQ ID NO: 263 - DNA, 2265 bp, Homo sapiens
  Spinesin
acgcgggatacagggaggggccatgtgcgaaccagggagacctcatcttccaaccaagcttgctgggcttgcatttaatcaatgcatggccagagaacaggagcggaacattgcctagtagaccctgaggctttacaacagtgctactgacccctatgagcctgatgctggatgaccaaccccctatggaggcccagtatgcagaggagggcccaggacctgggatcttcagagcagagcctggagaccagcagcatcccatttctcaggcggtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcactccccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtgcgtgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagagactgctagaagcagcaggaagcctgcccttctgccctctcccctccctgcccctgtgtgagtcttttagggagggtgactgggaggtgccccccgtcccacctttttcctgtgctctaggtgggctaagtgcctccctagaggactccatggctgagaggctcctgggcagatggggtcaaggctgggccagtcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggaggttctgttattaaagtgatatatggtcttgaaaaaaaaaaaaaaaaaaaaaaa

SEQ ID NO: 264 - protein, 457 aa, Homo sapiens
  Spinesin
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRACAEPNHPGVYAKVAEFLDWIHDTAQDSLL

SEQ ID NO: 265 - DNA, 1243 bp, Homo sapiens
  Mername-AA178 peptidase
atggctgcccctgcttccgtcatgggcccactcgggccctctgccctgggccttctgctgctgctcctggtggtggcccctccccgggtcgcagcattggtccacagacagccagagaaccagggaatctccctaactggcagcgtggcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtgagacctcagacgagctgcaggagatgcagctcccgctgatcctggagccctggtgccacctgctctacggacacatgtcctacatcatgcccgacatgctgtgtgctggggacatcctgaatgctaagaccgtgtgtgagggcgactccgggggcccacttgtctgtgaattcaaccgcagctggttgcagattggaattgtgagctggggccgaggctgctccaaccctctgtaccctggagtgtatgccagtgtttcctatttctcaaaatggatatgtgataacatagaaatcacgcccactcctgctcagccagcccctgctctctctccagctctggggcccactctcagcgtcctaatggccatgctggctggctggtcagtgctgtgaggtcaggatacccactctaggattctcatggctgcacaccctgccccagcccagctgcctccagacccctaagcatctcctgtcctggcctctctgaagcagacaagggccacctatcccgggggtggatgctgagtccaggaggtgatgagcaagtgtacaaaagaaaaaagggaagggggagaggggctggtcagggagaacccagcttgggcagagtgcacctgagatttgataagatcattaaatatttacaaagcaa

SEQ ID NO: 266 - protein, 326 aa, Homo sapiens
  Mername-AA178 peptidase
MAAPASVMGPLGPSALGLLLLLLVVAPPRVAALVHRQPENQGISLTGSVACGRPSMEGKILGGVPAPERKWPWQVSVHYAGLHVCGGSILNEYWVLSAAHCFHRDKNIKIYDMYVGLVNLRVAGNHTQWYEVNRVILHPTYEMYHPIGGDVALVQLKTRIVFSESVLPVCLATPEVNLTSANCWATGWGLVSKQGETSDELQEMQLPLILEPWCHLLYGHMSYIMPDMLCAGDILNAKTVCEGDSGGPLVCEFNRSWLQIGIVSWGRGCSNPLYPGVYASVSYFSKWICDNIEITPTPAQPAPALSPALGPTLSVLMAMLAGWSVL

SEQ ID NO: 267 - DNA, 1695 bp, Homo sapiens
  Mername-AA180 peptidase
atgcttataagcaggaacaagctgattttactactaggaatagtcttttttgaacgaggtaaatctgcaactctttcgctccccaaagctcccagttgtgggcagagtctggttaaggtacagccttggaattattttaacattttcagtcgcattcttggaggaagccaagtggagaagggttcctatccctggcaggtatctctgaaacaaaggcagaagcatatttgtggaggaagcatcgtctcaccacagtgggtgatcacggcggctcactgcattgcaaacagaaacattgtgtctactttgaatgttactgctggagagtatgacttaagccagacagacccaggagagcaaactctcactattgaaactgtcatcatacatccacatttctccaccaagaaaccaatggactatgatattgcccttttgaagatggctggagccttccaatttggccactttgtggggcccatatgtcttccagagctgcgggagcaatttgaggctggttttatttgtacaactgcaggctggggccgcttaactgaaggtggcgtcctctcacaagtcttgcaggaagtgaatctgcctattttgacctgggaagagtgtgtggcagctctgttaacactaaagaggcccatcagtgggaagacctttctttgcacaggttttcctgatggagggagagacgcatgtcagggagattcaggaggttcactcatgtgccggaataagaaaggggcctggactctggctggtgtgacttcctggggtttgggctgtggtcgaggctggagaaacaatgtgaggaaaagtgatcaaggatcccctgggatcttcacagacattagtaaagtgcttccctggatccacgaacacatccaaactggtaatcggagaaagagctccagagcctggtgcagtgagcaggatgtcatagtcagcggggctgaggggaagctgcacttcccagaaagcctccacctatattatgagagcaagcaacggtgtgtctggaccctgctggtaccagaggaaatgcatgtgttgctcagtttttcccacctagatgttgagtcttgtcaccacagttacctgtcaatgtattctttagaagacagacccattggaaaattttgtggagaaagcctcccttcatccattcttattggctctaattctctaaggctgaaattcgtctctgatgccacagattatgcagctgggtttaatcttacctataaagctcttaaaccaaactacattcctgattcaggttgcagttacttaactgtcctttttgaagaaggtctcatacagagtctaaactatcctgaaaactacagtgacaaggctaactgtgactggatttttcaagcctccaaacatcacctaattaagctttcatttcagagtctggaaatagaagaaagtggagactgcacttccgactatgtgacagtgcacagcgatgtagaaaggaagaaggaaatagctcggctgtgtggctatgatgtccccacccctgtgctgagcccctccagcatcatgctcatcagcttccaatcagatgaaaacgggacctgcaggggctttcaggctacagtctccttcattcctaaagcaggtaagaagatagagttaccaactctttggttcccagttctaatccttgtgatgtga

SEQ ID NO: 268 - protein, 564 aa, Homo sapiens
  Mername-AA180 peptidase
MLISRNKLILLLGIVFFERGKSATLSLPKAPSCGQSLVKVQPWNYFNIFSRILGGSQVEKGSYPWQVSLKQRQKHICGGSIVSPQWVITAAHCIANRNIVSTLNVTAGEYDLSQTDPGEQTLTIETVIIHPHFSTKKPMDYDIALLKMAGAFQFGHFVGPICLPELREQFEAGFICTTAGWGRLTEGGVLSQVLQEVNLPILTWEECVAALLTLKRPISGKTFLCTGFPDGGRDACQGDSGGSLMCRNKKGAWTLAGVTSWGLGCGRGWRNNVRKSDQGSPGIFTDISKVLPWIHEHIQTGNRRKSSRAWCSEQDVIVSGAEGKLHFPESLHLYYESKQRCVWTLLVPEEMHVLLSFSHLDVESCHHSYLSMYSLEDRPIGKFCGESLPSSILIGSNSLRLKFVSDATDYAAGFNLTYKALKPNYIPDSGCSYLTVLFEEGLIQSLNYPENYSDKANCDWIFQASKHHLIKLSFQSLEIEESGDCTSDYVTVHSDVERKKEIARLCGYDVPTPVLSPSSIMLISFQSDENGTCRGFQATVSFIPKAGKKIELPTLWFPVLILVM

SEQ ID NO: 269 - DNA, 3420 bp, Homo sapiens
  Mername-AA182 peptidase
atgggcctgctggccagtgctggtttgttgctgttgctggtcatcggccaccccagaagcctaggactgaagtgtggaattcgcatggtcaacatgaaaagtaaggaacctgccgtgggatctagattcttctctagaattagtagttggagaaattcaacagtgactggacatccatggcaggtctccctaaaatcagatgagcaccacttctgtggaggaagcttgattcaagaagatcgggttgttacagcagcacactgcctggacagcctcagtgagaagcagctgaagaatataactgtgacttctggggagtacagcctctttcagaaggataagcaagaacagaatattcctgtctcaaaaattattacccatcctgaatacaacagccgtgaatatatgagtcctgatattgcactgctgtatctaaaacacaaagtcaagtttggaaatgctgttcagccaatctgtcttcctgacagcgatgataaagttgaaccaggaattctttgcttatccagtggatggggcaagatttccaaaacatcagaatattcaaatgtcctacaagaaatggaacttcccatcatggatgacagagcgtgtaatactgtgctcaagagcatgaacctccctcccctgggaaggaccatgctgtgtgctggcttccctgattggggaatggacgcctgccagggggactctggaggaccactggtttgtagaagaggtggtggaatctggattcttgctgggataacttcctgggtagctggttgtgctggaggttcagttcccgtaagaaacaaccatgtgaaggcatcacttggcattttctccaaagtgtctgagttgatggattttatcactcaaaacctgttcacaggtttggatcggggccaacccctctcaaaagtgggctcaaggtatataacaaaggccctgagttctgtccaagaagtgaatggaagccagagaggaaagggtattttagacatggaaaagcaagttggatgtgatcatgactatgtatctttacgatcaagcagtggagtgctttttaatcagagatctctcatggaagacgatggaaaacaaaacaaacgtgtctgtggaaaaatattgccttcaccattgctggcagagaccagtgaggccatggttccatttgtttctgatacagaagacagtggcagtggctttgagcttaccgttactgctgtacagaagtcagaagcagggtcaggttgtgggagtctggctatattggtagaagaagggacaaatcactctgccaagtatcctgatttgtatcccagtaacacaaggtgtcattggttcatttgtgctccagagaagcacattataaagttgacatttgaggactttgctgtcaaatttagtccaaactgtatttatgatgctgttgtgatttacggtgattctgaagaaaagcacaagttagctaaactttgtggaatgttgaccatcacttcaatattcagttctagtaacatgacggtgatatactttaaaagtgatggtaaaaatcgtttacaaggcttcaaggccagatttaccattttgccctcagagtctttaaacaaatttgaaccaaagttacctccccaaaacaatcctgtatctaccgtaaaagctattctgcatgatgtctgtggcatccctccatttagtccccagtggctttccagaagaatcgcaggaggggaagaagcctgcccccactgttggccatggcaggtgggtctgaggtttctaggcgattaccaatgtggaggtgccatcatcaacccagtgtggattctgaccgcagcccactgtgtgcaattgaagaataatccactctcctggactattattgctggggaccatgacagaaacctgaaggaatcaacagagcaggtgagaagggccaaacacataatagtgcatgaagactttaacacactaagttatgactctgacattgccctaatacaactaagctctcctctggagtacaactcggtggtgaggccagtatgtctcccacacagcgcagagcctctattttcctcggagatctgtgctgtgaccggatggggaagcatcagtgcagatggtggcctagcaagtcgcctacagcagattcaagtgcatgtgttagaaagagaggtctgtgaacacacttactattctgcccatccaggagggatcacagagaagatgatctgtgctggctttgcagcatctggagagaaagatttctgccagggagactctggtgggccactagtatgtagacatgaaaatggtccctttgtcctctatggcattgtcagctggggagctggctgtgtccagccatggaagccgggtgtatttgccagagtgatgatcttcttggactggatccaatcaaaaatcaatggtcctgcttcacttcagacaaataataaatgcaaaaccttaaaacaacaattgccaccacccacaccttcaccagacagtgcatcttggccaggttgttgctctgaagcagagctagaaaagcctagaggcttttttcccacaccacggtatctactggattatagaggaagactggaatgttcttgggtgctcagagtttcagcaagcagtatggcaaaatttaccattgagtatctgtcactcctggggtctcctgtgtgtcaagactcagttctaattatttatgaagaaagacacagtaagagaaagacggcaggtggattacatggaagaagactttactcaatgactttcatgagtcctggaccgctggtgagggtgacattccatgcccttgtacgaggtgcatttggtataagctatattgacttgaaagtcctaggtccaaaggacagtaaaataaccagactttcccaaagttcaaacagagagcacttggtcccttgtgaggatgttcttctgaccaagccagaagggatcatgcagatcccaagaaattctcacagaactactatggggtgccaatggagattagtagcccctttaaatcacatcattcagcttaatattattaacttcccgatgaagccaacaacttttgtctgtcatggtcatctgcgtgtttacgaaggatttggaccaggaaaaaaattaatagcttcattcgctggaactctggcaatgatactgacaaaagacatattaaaaagagaaaaactgaattttattaacacatatatcatgcatatatgggaaaattcagtgtatgataatgtaagaagtgttggaaaaagaaaacagaagaaatttgcatcaaatttaagttatagtatggaggctgagaagtccaggatccaggtgccagcagatttggtgcctgctaagggctcactttctggttcttaggcacagcccattctc

SEQ ID NO: 270 - protein, 1134 aa, Homo sapiens
  Mername-AA182 peptidase
MGLLASAGLLLLLVIGHPRSLGLKCGIRMVNMKSKEPAVGSRFFSRISSWRNSTVTGHPWQVSLKSDEHHFCGGSLIQEDRVVTAAHCLDSLSEKQLKNITVTSGEYSLFQKDKQEQNIPVSKIITHPEYNSREYMSPDIALLYLKHKVKFGNAVQPICLPDSDDKVEPGILCLSSGWGKISKTSEYSNVLQEMELPIMDDRACNTVLKSMNLPPLGRTMLCAGFPDWGMDACQGDSGGPLVCRRGGGIWILAGITSWVAGCAGGSVPVRNNHVKASLGIFSKVSELMDFITQNLFTGLDRGQPLSKVGSRYITKALSSVQEVNGSQRGKGILDMEKQVGCDHDYVSLRSSSGVLFNQRSLMEDDGKQNKRVCGKILPSPLLAETSEAMVPFVSDTEDSGSGFELTVTAVQKSEAGSGCGSLAILVEEGTNHSAKYPDLYPSNTRCHWFICAPEKHIIKLTFEDFAVKFSPNCIYDAVVIYGDSEEKHKLAKLCGMLTITSIFSSSNMTVIYFKSDGKNRLQGFKARFTILPSESLNKFEPKLPPQNNPVSTVKAILHDVCGIPPFSPQWLSRRIAGGEEACPHCWPWQVGLRFLGDYQCGGAIINPVWILTAAHCVQLKNNPLSWTIIAGDHDRNLKESTEQVRRAKHIIVHEDFNTLSYDSDIALIQLSSPLEYNSVVRPVCLPHSAEPLFSSEICAVTGWGSISADGGLASRLQQIQVHVLEREVCEHTYYSAHPGGITEKMICAGFAASGEKDFCQGDSGGPLVCRHENGPFVLYGIVSWGAGCVQPWKPGVFARVMIFLDWIQSKINGPASLQTNNKCKTLKQQLPPPTPSPDSASWPGCCSEAELEKPRGFFPTPRYLLDYRGRLECSWVLRVSASSMAKFTIEYLSLLGSPVCQDSVLIIYEERHSKRKTAGGLHGRRLYSMTFMSPGPLVRVTFHALVRGAFGISYIDLKVLGPKDSKITRLSQSSNREHLVPCEDVLLTKPEGIMQIPRNSHRTTMGCQWRLVAPLNHIIQLNIINFPMKPTTFVCHGHLRVYEGFGPGKKLIASFAGTLAMILTKDILKREKLNFINTYIMHIWENSVYDNVRSVGKRKQKKFASNLSYSMEAEKSRIQVPADLVPAKGSLSGS

SEQ ID NO: 271 - DNA, 2810 bp, Homo sapiens
  Mername-AA122 peptidase
acttggctctgcctccgctgactctagcgccatggcccggcacctgctcctcccccttgtgatgcttgtcatcagtcccatcccaggagccttccaggactcagctctcagtcctacccaggaagaacctgaagatctggactgcgggcgccctgagccctcggcccgcatcgtgggggggctcaaacgcgcagccgggcacctggccttggcaagtgagcctgcaccatggaggtggccacatctgcgggggctccctcatcgccccctcctgggtcctctccgctgctcactgtttcatgacgaatgggacgctggagcccgcggccgagtggtcggtactgctgggcgtgcactcccaggacgggcccctggacggcgcgcacacccgcgcagtggccgccatcgtggtgccggccaactacagccaagtggagctgggcgccgacctggccctgctgcgcctggcctcacccgccagcctgggccccgccgtgtggcctgtctgcctgccccgcgcctcacaccgcttcgtgcacggcaccgcctgctgggccaccggctggggagacgtccaggaggcagatcctctgcctctcccctgggtgctacaggaagtggagctaaggctgctgggcgaggccacctgtcaatgtctctacagccagcccggtcccttcaacctcactctccagatattgccagggatgctgtgtgctggctacccagagggccgcagggacacctgccagggcgactctggggggcccctggtctgtgaggaaggcggccgctggttccaggcaggaatcaccagctttggctttggctgtggacggagaaaccgccctggagttttcactgctgtggctacctatgaggcatggatacgggagcaggtgatgggttcagagcctgggcctgcctttcccacccagccccagaagacccagtcagatccccaggagcccagggaggagaactgcaccattgccctgcctgagtgcgggaaggccccgcggccaggggcctggccctgggaggcccaggtgatggtgccaggatccagaccctgccatggggcgctggtgtctgaaagctgggtcttggcacctgccagctgctttctggacccgaacagctccgacagcccaccccgcgacctcgacgcctggcgcgtgctgctgccctcgcgcccgcgcgcggagcgggtggcgcgcctggtgcagcacgagaacgcttcgtgggacaacgcctcggacctggcgctgctgcagctgcgcacgcccgtgaacctgagtgcggcttcgcggcccgtgtgcctaccccacccggaacactacttcctgcccgggagccgctgccgcctggcccgctggggccgcggggaacccgcgcttggcccaggcgcgctgctggaggcggagctgttaggcggctggtggtgccactgcctgtacggccgccagggggcggcagtaccgctgcccggagacccgccgcacgcgctctgccctgcctaccaggaaaaggaggaggtgggcagctgctggaatgactcgcgttggagccttttgtgccaggaggaggggacctggtttctggctggaatcagagactttcccagtggctgtctacgtccccgagccttcttccctctgcagactcatggcccatggatcagccatgtgactcggggagcctacctggaggaccagctagcctgggactggggccctgatggggaggagactgagacacagacttgtcccccacacacagagcatggtgcctgtggcctgcggctggaggctgctccagtgggggtcctgtggccctggctggcagaggtgcatgtggctggtgatcgagtctgcactgggatcctcctggccccaggctgggtcctggcagccactcactgtgtcctcaggccaggctctacaacagtgccttacattgaagtgtatctgggccgggcaggggccagctccctcccacagggccaccaggtatcccgcttggtcatcagcatccggctgccccagcacctgggactcaggccccccctggccctcctggagctgagctcccgggtggagccctccccatcagccctgcccatctgtctccacccggcgggtatccccccgggggccagctgctgggtgttgggctggaaagaaccccaggaccgagtccctgtggctgctgctgtctccatcttgacacaacgaatctgtgactgcctctatcagggcatcctgccccctggaaccctctgtgtcctgtatgcagaggggcaggagaacaggtgtgagatgacctcagcaccgcccctcctgtgccagatgacggaagggtcctggatcctcgtgggcatggctgttcaagggagccgggagctgtttgctgccattggtcctgaagaggcctggatctcccagacagtgggagaggccaacctcctgccccccagtggctccccacactggcccactggaggcagcaatctctgccccccagaactggccaaggcctcgggatccccgcatgcagtctacttcctgctcctgctgactctcctgatccagagctgaggggctagggtcccagcaccacttcccccttctccaccctctacttcccgcccagtggggctggaatgtggcccagccggctggaacctcaagggccccacccaccgagattgcagcggctctggctaattgggcctctgtgcccgggctattttgaacccaggaatccttgggggtggtgggaggagcggacaataaaggtgtaaacac

SEQ ID NO: 272 - protein, 766 aa, Homo sapiens
  Mername-AA122 peptidase
MTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANLLPPSGSPHWPTGGSNLCPPELAKASGSPHAVYFLLLLTLLIQS

SEQ ID NO: 273 - DNA, 1575 bp, Homo sapiens
  Cathepsin L
agaaccgcgacctccgcaaccttgagcggcatccgtggagtgcgcctgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 274 - protein, 333 aa, Homo sapiens [sequence omitted]

SEQ ID NO: 275 - DNA, 1342 bp, Homo sapiens
  Cathepsin V
cggctgtaatctcagaggcttgtttgctgagggtgcctgcgcacgtgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttcctgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagttt

SEQ ID NO: 276 - protein, 334 aa, Homo sapiens
  Cathepsin V
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 277 - DNA, 1661 bp, Homo sapiens
  Cathepsin K
attcggcacgagccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttggttctctcctcccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttcaatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagttta

SEQ ID NO: 278 - protein, 329 aa, Homo sapiens
  Cathepsin K
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 279 - DNA, 1255 bp, Homo sapiens
  Cathepsin S
ctaaagatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgacgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgactctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatgggagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaatagaaaatatagtttgaggccgggcactgtctggctcacgcctgtaatcccagtacttgggaggccaaggaggcatatcaacttgaggccaggagttaaagagcagcctggctaactgtgaaaccctctctact

SEQ ID NO: 280 - protein, 331 aa, Homo sapiens
  Cathepsin S
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVTLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 281 - DNA, 1517 bp, Homo sapiens
  Cathepsin F
gaattccgggtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggtcaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtgggacagctcagtatggagtcaccaagttcagtgatctcacagaggaggagttccgcactatctacctgaatactctcctgaggaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgtgggtccggggcctgtggcgtgaacaccatggccagctcggcggtggtggactgaagaggggccccgaattc

SEQ ID NO: 282 - protein, 484 aa, Homo sapiens [sequence omitted]

SEQ ID NO: 283 - DNA, 2002 bp, Homo sapiens
  Cathepsin B
aattccgcggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagccttccgagtagtggatctaggatctggcttccaacatgtggcagctctgggcctccctctgctgcctgctggtgttggccaatgcccggagcaggccctctttccatcccgtgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccgcatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgcggaatcgaatcagaagtggtggctggaattccacgcaccgatcagtactgggaaaagatctaatctgccgtgggcctgtcgtgccagtcctgggggcgagatcggggtagaaagtcattttattctttaagttcacgtaagatacaagtttcaggcagggtctgaaggactggattggccaaagtcctccaaggagaccaagtcctggctacatcccagcctgtggttacagtgcagacaggccatgtgagccaccgctgccagcacagagcgtccttccccctgtagactagtgccgtgggagtacctgctgcccagctgctgtggccccctccgtgatccatccatctccagggagcaagacagagacgcaggatggaaagcggagttcctaacaggatgaaagttcccccatcagttcccccagtacctccaagcaagtagctttccacatttgtcacagaaatcagaggagagatggtgttgggagccctttggagaacgccagtctccaggtccccctgcatctatcgagtttgcaatgtcacaacctctctgatcttgtgctcagcatgattctttaatagaagttttatttttcgtgcactctgctaatcatgtgggtgagccagtggaacagcgggagcctgtgctggtttgcagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttg

SEQ ID NO: 284 - protein, 339 aa, Homo sapiens
  Cathepsin B
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 285 - DNA, 1292 bp, Carica papaya
  Papain
atccattcccacttaagaagtaaaaagatatagctagtgtcacaatggctatgataccttcaatttcaaagttgctttttgttgcaatatgtctttttgtttatatgggtttgtcatttggtgatttttctattgtgggttattctcaaaatgacttgacatccactgaaagacttattcagctatttgaatcgtggatgttgaagcacaataagatttataagaatattgatgaaaaaatctacagatttgaaatttttaaagataatcttaaatatattgatgagacaaataagaaaaataacagttattggcttggattaaatgtgtttgctgatatgagcaatgatgaattcaaagaaaagtatactggttctattgctggaaattatacaacaaccgaactatcatacgaagaagtgcttaatgatggtgatgtaaatatcccggagtatgtcgattggagacaaaaaggagctgtcactcctgtaaaaaatcagggttcttgtggtagttgttgggcattctcagctgttgtaactatagagggaataattaagattagaactgggaacttaaatgaatactcagagcaagaactgcttgactgcgacagacgtagctacgggtgcaatggaggttacccttggagtgcacttcaattagtggctcaatatggtattcactacagaaatacttacccatatgagggagtgcaacgttattgtcgctcaagggagaaaggtccttatgcagccaaaaccgatggggttcgacaagtgcaaccatataatgaaggggctctcttatattcaattgcaaaccaacctgtgagcgttgtccttgaagctgctggaaaagatttccaattatatagagggggaatatttgtggggccatgcggaaacaaagtagatcatgcagtcgcagcagttgggtatggaccaaattacatactcataaagaattcatggggtacaggatggggtgaaaatggatatataagaatcaaaagaggcactggaaactcctatggagtatgtggactttatacaagctcattctatcctgttaaaaactgatgagatcacggctttcataaaatcccttatatatatatatatatatagaacttgtatactcatcgtgtgttgaaataataaatgagaggattaataatttgtgtaatcctatatatcacagtttgttgtgacaaacttttgcatcgcttgttatattatttgtaataatgtttgttttgattgaataaacttttacatatacttttatgc

SEQ ID NO: 286 - protein, 345 aa, Carica papaya
  Papain
MAMIPSISKLLFVAICLFVYMGLSFGDFSIVGYSQNDLTSTERLIQLFESWMLKHNKIYKNIDEKIYRFEIFKDNLKYIDETNKKNNSYWLGLNVFADMSNDEFKEKYTGSIAGNYTTTELSYEEVLNDGDVNIPEYVDWRQKGAVTPVKNQGSCGSCWAFSAVVTIEGIIKIRTGNLNEYSEQELLDCDRRSYGCNGGYPWSALQLVAQYGIHYRNTYPYEGVQRYCRSREKGPYAAKTDGVRQVQPYNEGALLYSIANQPVSVVLEAAGKDFQLYRGGIFVGPCGNKVDHAVAAVGYGPNYILIKNSWGTGWGENGYIRIKRGTGNSYGVCGLYTSSFYPVKN

SEQ ID NO: 287 - DNA, 1845 bp, Trypanosoma cruzi
  Cruzain (Cruzapain)
atgtctggctgggcgcgtgcgctgttgctcgcggccgtcctggtcgtcatggcgtgcctcgtccccgcggcgacggcgagcctgcatgcggaggagacgctgacgtcgcaattcgcagaattcaagcagaagcatggcagggtgtacgagagcgccgcggaggaggcgttccgcctgagcgtgttcagggagaacctgtttcttgcgaggctgcacgccgcggcaaacccacacgcgaccttcggcgtcacgcccttctcggacctcacgcgcgaggaattccggtcccgctaccacaacggcgcggcgcactttgcggcggcgcaggagcgcgcgagagtgccggtgaaggtggaggtagttggcgcgcccgcggcagtggattggcgtgcgagaggcgccgtgacagccgtcaaggaccagggccaatgcggttcgtgctgggccttctccgccattggcaacgttgagtgccagtggtttcttgccggccacccgctgacgaacctgtcggagcagatgctcgtgtcgtgcgacaaaacggactctggctgcagtggtggcctgatgaacaacgcctttgagtggattgtgcaggagaataacggcgccgtgtacacggaggacagctacccttatgcgtcgggcgaggggatatcgccgccgtgcacgacgtcaggccacacggtgggtgccacgattaccggtcacgttgaattacctcaggacgaggcccaaatagccgcatggcttgcagtcaatggcccggttgccgttgccgtcgacgccagcagctggatgacctacacgggcggcgttatgacgagctgcgtctccgagcagctggatcacggcgttcttctcgtcggctacaatgacagcgccgcagtgccgtactggatcatcaagaactcgtggaccacgcagtggggcgaggaaggctacatccgcattgcaaagggctcgaaccagtgccttgtcaaggaggaggcgagctccgcggtggtcggtggtcccggacccactcccgagccaaccaccacgacaaccacaagtgccccaggaccgtccccatcgtactttgtgcagatgtcctgcactgacgctgcgtgcattgtcgggtgcgagaacgtgacgttaccgaccggtcagtgtctcctgaccaccagcggcgtctctgccattgtcacgtgcggtgctgagactctcacagaagaagtcttccttacgagtacgcactgcagcggcccatcggtgaggtcctctgttcctctcaacaaatgcaaccggcttttaagaggctccgttgagttcttctgcggctccagctccagtggccgactggccgacgtggacaggcagcgtcgccatcagccataccacagccgtcatcgccgcctctgagggcactctttgtttctgatgctgccttttctctcattttacttttttattattattgagcgagcgtcggtgctgcggcacactgggcaaataagtcccagtggagtggattgtttattgatttgctccatgtatgtgttttcttttttgtgcacaactgcaaatatgtgtccgcgatcgacgtctcagccacgcgtgtgttttttctattatatgcttctgttgagcgcccgagcattccccactgtggctgaacccaccgccgtccccgactgtcacccgaccatgcggggcggggtggcgtggcaacgctcctttgccgcggcgtgcacatacacgcgcgcatgcttcttctctccacgtcaacgccgacaccaccacagtctgaaggtgacgctgttgaaggcacacaaggaaggaaacacacccacacaagcagta

SEQ ID NO: 288 - protein, 467 aa, Trypanosoma cruzi
  Cruzain (Cruzapain)
MSGWARALLLAAVLVVMACLVPAATASLHAEETLTSQFAEFKQKHGRVYESAAEEAFRLSVFRENLFLARLHAAANPHATFGVTPFSDLTREEFRSRYHNGAAHFAAAQERARVPVKVEVVGAPAAVDWRARGAVTAVKDQGQCGSCWAFSAIGNVECQWFLAGHPLTNLSEQMLVSCDKTDSGCSGGLMNNAFEWIVQENNGAVYTEDSYPYASGEGISPPCTTSGHTVGATITGHVELPQDEAQIAAWLAVNGPVAVAVDASSWMTYTGGVMTSCVSEQLDHGVLLVGYNDSAAVPYWIIKNSWTTQWGEEGYIRIAKGSNQCLVKEEASSAVVGGPGPTPEPTTTTTTSAPGPSPSYFVQMSCTDAACIVGCENVTLPTGQCLLTTSGVSAIVTCGAETLTEEVFLTSTHCSGPSVRSSVPLNKCNRLLRGSVEFFCGSSSSGRLADVDRQRRHQPYHSRHRRL

SEQ ID NO: 289 - protein, 379 aa, Bacillus licheniformis
  Subtilisin Carlsberg precursor S08.001
MMRKKSFWLGMLTAFMLVFTMAFSDSASAAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGTYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 290 - DNA, 1588 bp, Bacillus licheniformis
  Subtilisin Carlsberg precursor S08.001
gatcgacaagaccgcaacctccttcgacaaaaaatgatctcttaaaataaatgaatagtattttcataaaatgaatcagatggagcaatctcctgtcattcgcggccctcgggacctctttccctgccaggctgaagcggtctattcatactttcgaactgaacatttttctaaaacagttattaataaccaaaaaattttaaattggtcctccaaaaaaataggcctaccatataattcattttttttctataataaattaacagaataattggaatagattatattatccttctatttaaattattctgaataaagaggaggagagtgagtaatgatgaggaaaaagagtttttggcttgggatgctgacggccttcatgctcgtgttcacgatggcattcagcgattccgcttctgctgctcaaccggcgaaaaatgttgaaaaggattatattgtcggatttaagtcaggagtgaaaaccgcatctgtcaaaaaggacatcatcaaagagagcggcggaaaagtggacaagcagtttagaatcatcaacgcggcaaaagcgaagctagacaaagaagcgcttaaggaagtcaaaaatgatccggatgtcgcttatgtggaagaggatcatgtggcccatgccttggcgcaaaccgttccttacggcattcctctcattaaagcggacaaagtgcaggctcaaggctttaagggagcgaatgtaaaagtagccgtcctggatacaggaatccaagcttctcatccggacttgaacgtagtcggcggagcaagctttgtggctggcgaagcttataacaccgacggcaacggacacggcacacatgttgccggtacagtagctgcgcttgacaatacaacgggtgtattaggcgttgcgccaagcgtatccttgtacgcggttaaagtactgaattcaagcggaagcggaacttacagcggcattgtaagcggaatcgagtgggcgacgacaaacggcatggatgttatcaacatgagtcttggaggaccatcaggctcaacagcgatgaaacaggcggttgacaatgcatatgcaagaggggttgtcgttgtggcggctgctgggaacagcggatcttcaggaaacacgaatacaatcggctatcctgcgaaatacgactctgtcatcgcagttggcgcggtagactctaacagcaacagagcttcattttccagcgtcggagcagagcttgaagtcatggctcctggcgcaggcgtgtacagcacttacccaaccagcacttatgcaacattgaacggaacgtcaatggcttctcctcatgtagcgggagcagcagctttgatcttgtcaaaacatccgaacctttcagcttcacaagtccgcaaccgtctctccagtacggcgacttatttgggaagctccttctactatggaaaaggtctgatcaatgtcgaagctgccgctcaataacatattctaacaaatggcatatagaaaaagctagtgtttttagcactagctttttcttcattcagttgaagactgttcaatattttgaatccgttccattatggtcggatggcc

SEQ ID NO: 291 - protein, 275 aa, Bacillus pumilus
  Subtilisin (Alkaline mesentericopeptidase) S08.002
AQSVPYGISQIKAPALHSQGYTGSNVKVAVIDSGIDSSHPDLNVRGGASFVPSETNPYQDGSSHGTHVAGTIAALNNSIGVLGVAPSSALYAVKVLDSTGSGQYSWIINGIEWAISNNMDVINMSLGGPTGSTALKTVVDKAVSSGIVVAAAAGNEGSSGSTSTVGYPAKYPSTIAVGAVNSANQRASFSSAGSELDVMAPGVSIQSTLPGGTYGAYNGTSMATPHVAGAAALILSKHPTWTNAQVRDRLESTATYLGSSFYYGKGLINVQAAAQ

SEQ ID NO: 292 - protein, 269 aa, Bacillus lentus
  Subtilisin Savinase (Alkaline protease)  S08.003
AQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 293 - protein, 279 aa, Thermoactinomyces vulgaris [sequence omitted]

SEQ ID NO: 294 - protein, 401 aa, Bacillus sp. AK1
  Thermophilic serine proteinase precursor (Ak.1 protease)  S08.009
MKFKAIVSLSLAVSMSLFPFLVEAASNDGVESPKTVSEINVSHEKGAYVQGEVIVQFKEQVNAEEKAKALKEVGATAVPDNDRVKSKFNVLKVGNVEAVVKALNNNPLVEYAEPNYLFNAAWTPNDTYYQGYQYGPQNTYTDYAWDVTKGSSGQEIAVIDTGVDYTHPDLDGKVIKGYDFVDNDYDPMDLNNHGTHVAGIAAAETNNATGIAGMAPNTRILAVRALDRNGSGTLSDIADAIIYAADSGAEVINLSLGCDCHTTTLENAVNYAWNKGSVVVAAAGNNGSSTTFEPASYENVIAVGAVDQYDRLASFSNYGTWVDVVAPGVDIVSTITGNRYAYMSGTSMASPHVAGLAALLASQGRNNIEIRQAIEQTADKISGTGTYFKYGRINSYNAVTY

SEQ ID NO: 295 - DNA, 1591 bp, Bacillus sp
  Thermophilic serine proteinase precursor (Ak.1 protease)	 S08.009
gcatgctacgattaaatatctaagaatccccaattaaataccattattttacaaaattatattatattaaaataaatgtcgagatttttgagaaaaaatttttcattcctcccccttcctcaacgtaaaattaataccgcaattccatttaaagggggaatatttccatgaagtttaaagcgattgtaagtttatccctcgctgtttccatgtcactttttccattccttgtggaagcagcctctaatgatggggtagaatctccaaaaaccgtttccgaaattaacgtgtctcatgaaaaaggagcatatgtccagggagaagtcattgtccaattcaaagaacaagtaaatgctgaagaaaaggcaaaggcattaaaagaagttggggcaacggcggttccagataatgatcgagttaaatctaaatttaatgtactaaaagtaggaaatgtggaagctgttgtgaaagcattaaataataacccgttagtagaatacgcagagccaaactatttatttaatgcagcttggactccaaatgatacgtactatcagggttatcaatatggtccacaaaatacgtataccgactatgcttgggatgttacaaaaggcagtagcggtcaagagattgctgttattgatacaggtgtagattatacacatcctgatttagatggaaaagtcatcaaaggatatgatttcgtagataatgattacgacccaatggatttgaataatcatggtacgcacgtagctggaatagcagctgcggaaacaaacaatgctacaggtattgccggcatggccccaaacacaagaattttggctgtgcgcgctttagatcgaaatggcagtggtactctaagtgatattgccgatgcgatcatttatgctgctgattcaggcgctgaagtcattaacctgtcacttggttgtgattgtcatacaaccacattggagaatgctgtaaactatgcatggaataagggttctgtagtagttgccgcagccggaaataatggatcctctacaacatttgaaccggcttcttatgaaaatgtaattgcagttggcgcagtagatcaatatgatcggttagcatcattctcgaactatggaacatgggtagatgtcgtagctccaggtgtagacattgtctcaactattactggtaaccgatatgcctatatgtcgggcacttccatggcatcccctcatgtagccggtcttgcagccttactagcgagtcaaggacggaataacatagaaattcgtcaagccatcgagcaaacagcagacaaaatctccggaactggaacatacttcaaatatggaagaatcaattcttataatgctgtaacatattaaatagatttaaataacgacaccgtgccaacgccaagggcacggtgtcttaattcaagctttttggaaaatcacgacatacaaattatgtaagaaagcttattctcccataggaattgaagaggaaaaccaatattattcttttatctcagcaaaaataaaaaaactgccaaatggcagactctaactaactattttttgcttccttctttctgctgcag

SEQ ID NO: 296 - protein, 1167 aa, Streptococcus pyogenes
  C5a peptidase precursor (SCP) S08.020
MRKKQKLPFDKLAIALMSTSILLNAQSDIKANTVTEDTPVTEQAVETPQPTAVSEEVPSSKETKTPQTPDDAEETIADDANDLAPQAPAKTADTPATSKATIRDLNDPSQVKTLQEKAGKGAGTVVAVIDAGFDKNHEAWRLTDKTKARYQSKEDLEKAKKEHGITYGEWVNDKVAYYHDYSKDGKTAVDQEHGTHVSGILSGNAPSETKEPYRLEGAMPEAQLLLMRVEIVNGLADYARNYAQAIRDAVNLGAKVINMSFGNAALAYANLPDETKKAFDYAKSKGVSIVTSAGNDSSFGGKTRLPLADHPDYGVVGTPAAADSTLTVASYSPDKQLTETAMVKTDDQQDKEMPVLSTNRFEPNKAYDYAYANRGMKEDDFKDVKGKIALIERGDIDFKDKVANAKKAGAVGVLIYDNQDKGFPIELPNVDQMPAAFISRKDGLLLKDNPQKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQATVQTDKVDGKHFALAPKVLYEASWQKITIPANSSKQVTVPIDASRFSKDLLAQMKNGYFLEGFVRFKQDPTKEELMSIPYIGFRGDFGNLSAVEKPIYDSKDGSSYYHEANSDAKDQLDGDGLQFYALKNNFTALTTESNPWTIIKAVKEGVENIEDIESSEITETIFAGTFAKQDDDSHYYIHRHANGEPYAAISPNGDGNRDYVQFQGTFLRNAKNLVAEVLDKEGNVVWTSEVTEQVVKNYNNDLASTLGSTRFEKTRWDGKDKDGKVVANGTYTYRVRYTPISSGAKEQHTDFDVIVDNTTPEVATSATFSTEDRRLTLASKPKTSQPVYRERIAYTYMDEDLPTTEYISPNEDGTFTLPEEAETMEGATVPLKMSDFTYVVEDMAGNITYTPVTKLLEGHSNKPEQDGSGQTPDKKPEAKPEQDGSDQAPDKKPEAKPEQDGSGQTPDKKPETKPEKDSSGQTPGKTPQKGQPSRTLEKRSSKRALATKASTRDQLPTTNDKDTNRLHLLKLVMTTFFFGLVAHIFKTKRQKETKK

SEQ ID NO: 297 - DNA, 4637 bp, Streptococcus pyogenes
  C5a peptidase precursor (SCP) S08.020
cctgtattgatacatagcccaagaatatgcgtaaaaatagactcaatcaagcctttttcttgaaagcgacgggaataatttttgccataggttgtgaaatgtggcaccttgtcatccaaagtcaaacctaaaaaccagcgataggcagtattcacttcaatatccttgatggtctgacgcatggaacgaatgccataaaagcactgaatcagagggattttaaccaacatgacaggatcaaggctagggcgaccattatcagacgaataggtgtcttctactaggtcatagatgaagtcgaagtcaatcacagcttccacttagcgcaggaaatgttcatcaggcactaactggtcaagggtatagaaaccgtactgattgcggttatagtcaggtttttctttgtgtaacataggagaacctcacaagtcctttttcttatattatactcctaaatatcatgaaaagcccctagaaaagcgattctaaggactttgtcttcagtctgaagagagaaccgatcggttctctcttttatgtctaaaagaatgaggataaggaggtcacaaactaaacaactcttaaaaagctgacctttactaataatcgtcttttttttataataaagatgttagtaatataattgataaatgagatacatttaatcattatggcaaaagcaagaaaaatagctgtatcatatgcaaataacccctgtttgctctttaaaaaagatattatccttatttctccacgcacagatggacagctaggagagaatcgtttgattctctcttttcttaatggtcataaagacaaagtctctcatcaggaaaggacgacacattgcgtaaaaaacaaaaattaccatttgataaacttgccattgcgctcatgtctacgagcatcttgctcaatgcacaatcagacattaaagcaaatactgtgacagaagacactcctgttaccgaacaagccgtagaaaccccacaaccaacagcggtttctgaggaagtaccatcatcaaaggaaaccaaaaccccacaaactcctgatgacgcagaagaaacaatagcagatgacgctaatgatctagcccctcaagctcctgctaaaactgctgatacaccagcaacctcaaaagcgactattagggatttgaacgacccttctcaggtcaaaaccctgcaggaaaaagcaggcaagggagctgggactgttgttgcagtgattgatgctggttttgataaaaatcatgaagcgtggcgcttaacagacaaaaccaaagcacgttaccaatcaaaagaagatcttgaaaaagctaaaaaagagcacggtattacctatggcgagtgggtcaatgataaggttgcttattaccacgactatagcaaagatggtaaaaccgctgtcgatcaagagcacggcacacacgtgtcagggatcttgtcaggaaatgctccatctgaaacgaaagaaccttaccgcctagaaggtgcgatgcctgaggctcaattgcttttgatgcgtgtcgaaattgtaaatggactagcagactatgctcgtaactacgctcaagctatcagagatgctgtcaacttgggagctaaggtgattaatatgagctttggtaatgctgcactagcctacgctaacctcccagacgaaaccaaaaaagcctttgactatgccaaatcaaaaggtgttagcattgtgacctcagctggtaatgatagtagctttgggggcaagacccgtctacctctagcagatcatcctgattatggggtggttgggacacctgcagcggcagactcaacattgacagttgcttcttacagcccagataaacagctcactgaaactgctatggtcaaaacagacgatcagcaagataaagaaatgcctgttctttcaacaaaccgttttgagccaaacaaggcttacgactatgcttatgctaatcgtgggatgaaagaggatgattttaaggatgtcaaaggcaagattgcccttattgaacgtggcgatattgatttcaaagataaggttgcaaacgctaaaaaagctggtgctgtaggggtcttgatctatgacaatcaggacaagggcttcccgattgaattgccaaatgttgatcagatgcctgcggcctttatcagtcgaaaagacggtctcttattaaaagacaatccccaaaaaaccatcaccttcaatgcgacacctaaggtattgccaacagcaagtggcaccaaactaagccgcttctcaagctggggtctgacagctgacggcaatattaagccagatattgcagcacccggccaagatattttgtcatcagtggctaacaacaagtatgccaaactttctggaactagtatgtctgcgccattagtagcgggtatcatgggactgttgcaaaagcaatatgagacacagtatcctgatatgacaccatcagagcgtcttgatttagctaaaaaagtattgatgagctcagcaactgccttatatgatgaagatgaaaaagcttatttttctcctcgccaacaaggagcaggagcggtcgatgctaaaaaagcttcagcagcaacgatgtatgtgacagataaggataatacctcaagcaaggttcacctgaacaatgtttctgataaatttgaagtaacagtaactgttcacaacaaatctgataaacctcaagagttgtattaccaagcaactgttcaaacagataaagtagatggaaaacactttgccttggctcctaaagtattgtatgaggcatcatggcaaaaaatcacaattccagccaatagcagcaaacaagtcaccgttccaatcgatgctagtcgatttagcaaggacttgcttgcccaaatgaaaaatggctatttcttagaaggttttgttcgtttcaaacaagatcctacaaaagaagagcttatgagcattccatatattggtttccgaggtgattttggcaatctgtcagccgtagaaaaaccaatctatgatagcaaagacggtagcagctactatcatgaagcaaatagtgatgccaaagaccaattagatggtgatggattacagttttacgctctgaaaaacaactttacagcacttaccacagagtctaacccatggacgattattaaggctgtcaaagaaggggttgaaaacatagaggatatcgaatcttcagagatcacagaaaccatttttgcaggtacttttgcaaaacaagacgatgatagccactactatatccaccgtcacgctaatggcgagccatatgctgcgatctctccaaatggggacggtaacagagattatgtccaattccaaggtactttcttgcgtaatgctaaaaaccttgtggctgaagtcttggacaaagaaggaaatgttgtttggacaagtgaggtaaccgagcaagttgttaaaaactacaacaatgacttggcaagcacacttggttcaacccgttttgaaaaaactcgttgggacggtaaagataaagacggcaaagttgttgctaacggaacctacacctatcgtgtccgctacactccgattagttcaggtgcaaaagaacaacacactgattttgatgtgattgtagacaatacgacacctgaagtcgcaacatcggcaacattctcaacagaagatcgtcgtttgacacttgcatctaaaccaaaaaccagccaaccggtttaccgtgagcgtattgcttacacttatatggatgaggatctgccaacaacagagtatatttctccaaatgaagatggtacctttactcttcctgaagaggctgaaacaatggaaggcgctactgttccattgaaaatgtcagactttacttatgttgttgaagatatggctggtaatatcacttatacaccagtgactaagctattggagggccactctaataagccagaacaagacggttcaggtcaaacaccagataaaaaaccagaagctaaaccagaacaagacggttcagatcaagcaccagacaaaaaaccagaagctaaaccagaacaagacggttcaggtcaaacaccagataaaaaaccagaaactaaaccagaaaaagatagttcaggtcaaacaccaggtaaaactcctcaaaaaggtcaaccttctcgtactctagagaaacgctcttctaagcgtgctttagctacaaaagcatcaacaagagatcagttaccaacgactaatgacaaggatacaaatcgtttacatctccttaagttagttatgaccactttcttctttggattagtagctcatatctttaaaacaaaacgccaaaaagaaactaaaaaatagtattacttaaactgataagagcttatttaatagagggaaccaatttggttctctctatttttttagatgtgctgcctcatcaaaaagaagttaggacaaatagctgtcaacaattgccttttgcttatcttttcagttgctgtgataaaagatggcacgccaaacgcatgaagaaacttttgttttcagaaaactagattcataatgacaaaatcaatcaaagtagtacactatagatgaggtgactacgatgattgattttattatttctcaaccattctatttct

SEQ ID NO: 298 - protein, 699 aa, Fervidobacterium pennivorans
  fervidolysin  S08.020
MRKVLLIASIVALILALFSCANPSFEPRSKAKDLASLPEIKSQGYHILFGELRDGEYTEGKILVGYNDRSEVDKIVKAVNGKVVLELPQIKVVSIKLNGMTVKQAYDKIKALALKGIRYVEPSYKRELIKPTVVKPNPDMYKIRKPGLNSTARDYGEELSNELWGLEAIGVTQQLWEEASGTNIIVAVVDTGVDGTHPDLEGQVIAGYRPAFDEELPAGTDSSYGGSHGTHVAGTIAAKKDGKGIVGVAPGAKIMPIVIFDDPALVGGNGYVGDDYVAAGIIWATDHGAKVMNHSWGGWGYSYTMKEAFDYAMEHGVVMVVSAGNNTSDSHHQYPAGYPGVIQVAALDYYGGTFRVAGFSSRSDGVSVGAPGVTILSTVPGEDSIGYEGHNENVPATNGGTYDYYQGTSMAAPHVTGVVAVLLQKFPNAKPWQIRKLLENTAFDFNGNGWDHDTGYGLVKLDAALQGPLPTQGGVEEFQVVVTDAKGNFGVPTVFVSMMRDNGSCYYAKTGPDGIARFPHIDSGTYDIFVGGPDHWDRALAPYDGESIPGGYAIALRMAEERQASFVGFGVSPDATQLNVNFNSTLQVKFSTNLSTLKDPQFVVVDPLLRGVYGRVAYARNQTYDLSLLSGQISFGIQTLLPAATDITIQGTVTLNGEDIPVYGVLKAGTTWTIIDDFGGLNLGTDSQPIYVWWTIFGQ

SEQ ID NO: 299 - DNA, 2227 bp, Fervidobacterium pennivorans
  fervidolysin S08.020
aaaacagagatttaccacagatttgtaaccggtgagaactaagaaaggggggattgcgatgagaaaagtattgttgatagcttccattgttgctcttattctcgcgctcttttcatgtgcaaatccgagttttgagccaaggagcaaagcaaaagatttagcatcgttaccggagataaaatctcagggttaccatatactcttcggtgaattgagggacggggaatataccgagggtaaaatcctcgttggttacaacgataggtcggaagtagataaaatagtcaaagcagttaacggtaaagtagtgctcgaattaccacagattaaagtggtctccataaaactcaatggaatgacggttaaacaagcatacgacaagataaaggcacttgcacttaaaggtatcaggtatgttgaaccaagttacaagagggagctcataaaaccaacagttgtgaagccaaatcctgatatgtacaaaatcagaaaacctgggttgaacagtactgcaagagattacggtgaagaactttccaacgaactctggggccttgaggcaattggtgtaacacaacagctttgggaagaagcatcgggaacaaatattatcgttgcggttgttgatactggtgtcgacggcacccatccagatttggaagggcaagttatcgcaggatacagaccggcatttgatgaagaactcccagcaggaacagattcatcctacggtggttcacatggaacacacgttgctggaacgattgcggcaaagaaagatggaaaaggtatcgttggtgttgcacctggtgcaaagataatgccgatagttatattcgatgacccagcacttgttggtggaaatggttacgttggcgacgattatgtcgcagcaggtataatttgggcaacagaccatggtgcaaaggtaatgaaccactcttggggtggctggggttacagctacacaatgaaagaagcatttgattatgcgatggagcatggagttgtcatggttgtctcagctggtaacaatacatcagattcacaccatcaatatccagcaggttatcctggtgttatccaagttgctgctcttgactactacggtggaacatttagagtggcaggtttttcaagcagaagcgatggagtctcagttggcgcacctggagttacgattctctcgacggttcctggcgaagatagtatcggatacgaagggcacaacgaaaacgttcctgcaacaaatggcggtacttatgattactatcaaggaacctcaatggctgcaccgcatgtaacaggtgttgttgctgtattgctacaaaaattcccgaacgcaaaaccatggcagataagaaaattactcgaaaacacagcattcgattttaacggaaatggttgggatcacgataccggttatggtctggtaaagctcgatgcagcattgcaaggtcctcttccgacacaaggtggagtcgaagagttccaagtagttgttacggatgctaaaggaaatttcggagtcccaacggtctttgtatcaatgatgagagacaatggttcatgctattatgcgaaaacaggtcctgatggtatagcaaggttcccacacatcgacagcggcacttacgacatatttgttggtggaccagaccactgggatagagctctggctccttacgatggagaaagtattcccggaggttatgccattgctttgagaatggctgaggaaaggcaagcttccttcgtcggctttggagtttctccagatgcaacacaactcaatgtcaattttaattcgacactgcaagttaaattcagcactaacctctcaacactgaaagacccacaatttgtggttgttgatccgttactaagaggagtttacggtcgtgtggcatacgcaagaaatcaaacatacgatttgtcgttactctcaggtcaaatttcatttggtatacaaacgctcttaccagcagcgacagatattacaatccaaggaacagtaacattgaacggtgaagacatccctgtttacggagttctaaaagctggaaccacatggactataattgatgactttggtggattgaatttgggcaccgactcgcagccaatctatgtctggtggacaatcttcggacagtgatagtttcattttaacgtcaaagcaaaccgatggggtgttcagaccccatcggttttttgttttgccttt

SEQ ID NO: 300 - protein, 381 aa, Geobacillus stearothermophilus
  Subtilisin J precursor  S08.035
MRSKKLWISLLFALTLIFTMAFSNMSVQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVSPSASLYAVKVLDSTGSGQYSWIINGIEWAISNNMDVINMSLGGPSGSTALKTVVDKAVSSGIVVAAAAGNEGSSGSSSTVGYPAKYPSTIAVGAVNSSNQRASFSSAGSELDVMAPGVSIQSTLPGGTYGAYNGTSMATPHVAGAAALILSKHPTWTNAQVRDRLESTATYLGNSFYYGKGLINVQAAAQ

SEQ ID NO: 301 - DNA, 2494 bp, Geobacillus stearothermophilus
  Subtilisin J precursor S08.035
gaattctccattttcttctgctatcaaaataacagactcgtgattttccaaacgagctttcaaaaaagcctctgccccttgcaaatcggatgcctgtctataaaattcccgatattggttaaacaacggcgcaatggcggccgcatctgatgtctttgcttggcgaatgttcatcttatttcttcctccctctcaataattttttcattctatcccttttctgtaaagtttatttttcagaatacttttatcatcatgctttgaaaaaatatcacgataatatccattgttctcacggaagcacacgcaggtcatttgaacgaattttttcgacagaaatttgccgggactcaggagcatttaacctaaaaaagcatgacatttcagcataatgaacatttactcatgtctattttcgttcttttctgtatgaaaatagttatttcgagtctctacggaaatagcgagagatgatatacctaaatagagataaaatcatctcaaaaaaatgggtctactaaaatattattccatctattacaataaattcacagaatagtcttttaagtaagtctactctgaatttttttaaaaggagagggtaaagagtgagaagcaaaaaattgtggatcagcttgttgtttgcgttaacgttaatctttacgatggcgttcagcaacatgtctgtgcaggctgccggaaaaagcagtacagaaaagaaatacattgtcggatttaaacagacaatgagtgccatgagttccgccaagaaaaaggatgttatttctgaaaaaggcggaaaggttcaaaagcaatttaagtatgttaacgcggccgcagcaacattggatgaaaaagctgtaaaagaattgaaaaaagatccgagcgttgcatatgtggaagaagatcatattgcacatgaatatgcgcaatctgttccttatggcatttctcaaattaaagcgccggctcttcactctcaaggctacacaggctctaacgtaaaagtagctgttatcgacagcggaattgactcttctcatcctgacttaaacgtcagaggcggagcaagcttcgtaccttctgaaacaaacccataccaggacggcagttctcacggtacgcatgtagccggtacgattgccgctcttaataactcaatcggtgttctgggcgtcagcccaagcgcatcattatatgcagtaaaagtgcttgattcaacaggaagcggccaatatagctggattattaacggcattgaatgggccatttccaacaatatggatgttattaacatgagccttggcggaccttctggttctacagcgctgaaaacagtcgttgataaagccgtttccagcggtatcgtcgttgctgccgctgccggaaacgaaggttcgtccggaagctcaagcacagtcggctaccctgcaaaatatccttctactattgcggtaggtgcggtaaacagcagcaaccaaagagcttcattctcaagcgcaggttctgagcttgatgtgatggctcctggcgtatccatccaaagcacacttcctggaggcacttacggtgcttacaacggcacgtccatggcgactcctcacgttgccggagcagcagcgctaattctttctaagcacccgacttggacaaacgcgcaagtccgtgatcgtttagaaagcactgcaacatatcttggaaactctttctactatggaaaagggttaatcaacgtacaagcagctgcacaataatagtaaaaagaagcaggttcctccatacctgcttctttttatttgtcagcatcctgatgttccggcgcattctcttctttctccgtatgttgaatccgttccatgatcgaaggatggctgcctctgaaaatcttcacaagcaccggaggatcaacctggctcagccccgtcacggccaaatcctgaaacgttttaacagcggcttctctgttctctgtcaactcgatcccatactggtcagccttattctcctgataacgcgagacagcattagaaaaaggcgtcaccgcaaagctcaaaacagaaaacaaaagcaataacagcggaagtgccgcaagatcatgccgcccttctaaatgaaacatgctgcgggttaggcgaaccgtccgcttgtaaagcttatcaatgacataaaatccggcgagcgacacgagcaaataaccagccagaccgatgtaaacgtgcttcatgacataatggcccatttcgtggcccataataaacaggatttctgaatcgtcaagtttgttcagcgtcgtatcccacaatacaatccgtttattggccccaattcctgtaacataggcattcagcgcatttgttttttctgacatgttcacttcatatacatggtcagccggaatattggcttcatctgccagctctaaaattttgctttcaagctctttgtttttcagcggataaaaatcattgtataaaggatcgactctagaggatcc

SEQ ID NO: 302 - protein, 381 aa, Bacillus subtilis
  Subtilisin E precursor S08.036
MRSKKLWISLLFALTLIFTMAFSNMSVQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVSPSASLYAVKVLDSTGSGQYSWIINGIEWAISNNMDVINMSLGGPTGSTALKTVVDKAVSSGIVVAAAAGNEGSSGSTSTVGYPAKYPSTIAVGAVNSSNQRASFSSAGSELDVMAPGVSIQSTLPGGTYGAYNGTSMATPHVAGAAALILSKHPTWTNAQVRDRLESTATYLGNSFYYGKGLINVQAAAQ

SEQ ID NO: 303 - DNA, 1500 bp, Bacillus subtilis
  Subtilisin E precursor 	S08.036
gatatacctaaatagagataaaatcatctcaaaaaaatgggtctactaaaatattattccatctattacaataaattcacagaatagtcttttaagtaagtctactctgaatttttttaaaaggagagggtaaagagtgagaagcaaaaaattgtggatcagcttgttgtttgcgttaacgttaatctttacgatggcgttcagcaacatgtctgcgcaggctgccggaaaaagcagtacagaaaagaaatacattgtcggatttaaacagacaatgagtgccatgagttccgccaagaaaaaggatgttatttctgaaaaaggcggaaaggttcaaaagcaatttaagtatgttaacgcggccgcagcaacattggatgaaaaagctgtaaaagaattgaaaaaagatccgagcgttgcatatgtggaagaagatcatattgcacatgaatatgcgcaatctgttccttatggcatttctcaaattaaagcgccggctcttcactctcaaggctacacaggctctaacgtaaaagtagctgttatcgacagcggaattgactcttctcatcctgacttaaacgtcagaggcggagcaagcttcgtaccttctgaaacaaacccataccaggacggcagttctcacggtacgcatgtagccggtacgattgccgctcttaataactcaatcggtgttctgggcgttagcccaagcgcatcattatatgcagtaaaagtgcttgattcaacaggaagcggccaatatagctggattattaacggcattgagtgggccatttccaacaatatggatgttatcaacatgagccttggcggacctactggttctacagcgctgaaaacagtcgttgacaaagccgtttccagcggtatcgtcgttgctgccgcagccggaaacgaaggttcatccggaagcacaagcacagtcggctaccctgcaaaatatccttctactattgcagtaggtgcggtaaacagcagcaaccaaagagcttcattctccagcgcaggttctgagcttgatgtgatggctcctggcgtgtccatccaaagcacacttcctggaggcacttacggcgcttataacggaacgtccatggcgactcctcacgttgccggagcagcagcgttaattctttctaagcacccgacttggacaaacgcgcaagtccgtgatcgtttagaaagcactgcaacatatcttggaaactctttctactatggaaaagggttaatcaacgtacaagcagctgcacaataatagtaaaaagaagcaggttcctccatacctgcttctttttatttgtcagcatcctgatgttccggcgcattctcttctttctccgcatgttgaatccgttccatgatcgacggatggctgcctctgaaaatcttcacaagcaccggaggatcaacctgctcagccccgtcacggccaaatcctgaaacgttttaacactggcttctctgttctctgtc

SEQ ID NO: 304 - protein, 274 aa, Bacillus licheniformis
  Subtilisin DY  S08.037
AQTVPYGIPLIKADKVQAQGYKGANVKVGIIDTGIAASHTDLKVVGGASFVSGESYNTDGNGHGTHVAGTVAALDNTTGVLGVAPNVSLYAIKVLNSSGSGTYSAIVSGIEWATQNGLDVINMSLGGPSGSTALKQAVDKAYASGIVVVAAAGNSGSSGSQNTIGYPAKYDSVIAVGAVDSNKNRASFSSVGAELEVMAPGVSVYSTYPSNTYTSLNGTSMASPHVAGAAALILSKYPTLSASQVRNRLSSTATNLGDSFYYGKGLINVEAAAQ

SEQ ID NO: 305 - protein, 384 aa, Engyodontium album
  Proteinase K precursor  S08.054
MRLSVLLSLLPLALGAPAVEQRSEAAPLIEARGEMVANKYIVKFKEGSALSALDAAMEKISGKPDHVYKNVFSGFAATLDENMVRVLRAHPDVEYIEQDAVVTINAAQTNAPWGLARISSTSPGTSTYYYDESAGQGSCVYVIDTGIEASHPEFEGRAQMVKTYYYSSRDGNGHGTHCAGTVGSRTYGVAKKTQLFGVKVLDDNGSGQYSTIIAGMDFVASDKNNRNCPKGVVASLSLGGGYSSSVNSAAARLQSSGVMVAVAAGNNNADARNYSPASEPSVCTVGASDRYDRRSSFSNYGSVLDIFGPGTSILSTWIGGSTRSISGTSMATPHVAGLAAYLMTLGKTTAASACRYIADTANKGDLSNIPFGTVNLLAYNNYQA

SEQ ID NO: 306 - DNA, 2347 bp, Engyodontium album
  Proteinase K precursor	S08.054
cgaacagtataaagaaatagaggggacctaaactcatgttcaactctagggccccgttgaatcattcccccaaagtgggaacgccagtggcgacaaatctgtatactgtttcctgctttttctggtttgtcaaggttctcattaccctcttggctttctcctcttttcgcgacattgtgcttgtggtgtgcctatgtatgttgtagtcaatgctatatgtcaatggtttttgtcaaatgccatggcctagtggctctatgctggagctgctaattctgggcctttatcgactcctccgactagtcctgatgaagaagttgcaacactaccagcgtcacattcgccccattgatcacttcttgatccttcgcaataaccttcacggctgctcgaatgacttgacgtcacgatgggcctactatccaacttccagaacaggaaagtcgagatagttctacatagaccatggacgagttcatgagatgttggattcaaggataaatagctggccatgtcgccgcttcgatacagtttgtttcatctccatcatcagcatcaatcgcagcaatacaaagcatcctctcaaactcaacaaactttcttgattaagcaccgctttctcattcatcaacaacagccaaaatgcgtttgtctgttcttctgagtcttcttcccctcgctctcggcgctcctgccgttgagcagcgctccgaggctgctcctctgatcgaggcccgcggcgagatggttgccaacaagtacattgtcaagttcaaggagggtagcgctctttctgctctcgatgctgccatggagaagatttctggcaagcccgaccacgtctacaagaacgtcttcagtggtttcgctgcgacccttgacgagaacatggttcgggttctccgcgcccatcccgatgtaagttttcccatctataatctcttcccctaaaaagtctctcccttctaatatcgccgtcaggttgagtacattgagcaggatgctgttgtcaccatcaacgctgcgcagaccaacgctccctggggccttgctcgcatctccagcaccagccccggtacctctacttactactatgacgaatctgccggccaaggctcctgcgtctacgtgattgacaccggtatcgaggcatcgcaccccgagtttgagggtcgtgcccagatggtcaagacctactactactccagtcgcgacggtaacggtcacggcactcactgcgctggtaccgttggctcccgaacctacggtgtcgccaagaagacccagctctttggtgtcaaggtcctcgatgacaacggcagtggccagtactccaccatcatcgccggtatggactttgttgccagcgacaagaacaaccgcaactgccccaaaggtgtcgttgcctccttgtcccttggcggtggttactcctcctccgtgaacagcgccgctgccaggctccagagctctggtgtcatggtcgccgtcgctgccggtaacaacaacgctgacgcccgcaactactcccctgcttctgagccctcggtctgcactgtcggtgcttctgaccgctacgacagacgctccagcttctccaactacggcagcgttttggacatctttggccctggtaccagcattctctccacctggatcggcggcagcacccgctccatctctggaacttccatggctactccccacgttgccggtctcgctgcctacctcatgactcttggaaagactaccgccgccagcgcttgccgatacattgccgacaccgccaacaagggcgacttgagcaacattcccttcggcactgtcaacctgcttgcctacaacaactaccaggcttaagtccttcagtcaacgccaaaagctcaagatatgaaacaagttatgaatgcatctgtatatagacgagcatacttcatatcagtacataaccatccttagtatatttaaaaaggcaacgaatttgcagatttagctgtcagacagttagatttgcatgaatcagaagatatttgctttcataaattgcctcgtctcctttttgcgcttcacttattatctttcttgacaaattgaaacagtggcattaatttcctttctaaggaaatcgcatttaaatagtgaatgtaatcatatttgcacttactagaggtaggaccaaattatcgaggaacagttggtcatcgggcgggttcctcggcttctttctgttttagcaagtgtgtagtcctcgtgcatggccgatgatgattagtctgagagaacttgtgagctaacaacggcatctcgaggaaacgttcaactatgagccgaaagacaagtacttaat

SEQ ID NO: 307 - protein, 534 aa, Vibrio alginolyticus
  Alkaline serine exoprotease A precursor  S08.050
MLKKLLSCCITSALCFHSSLAFSQPNEIADSAELQQAPDTLPATLMLAPDDIAIADRYIVVFQQPQMMASSSPEFEQFTQQSVDRMSGLYSIQVESVFDHSISGFVANLSPEQLKDLRSDPRVDYIEQDRILSLDPIVSADANQTNAIWGLDRIDQRNLPLDNNYSANFDGTGVTAYVIDTGVNNAHVEFGGRSVSGYDFVDNDADASDCNGHGTHVAGTIGGSLYGVAKNVNLVGVRVLSCSGSGSTSGVIAGVDWVAANASGPSVANMSLGGGQSVALDSAVQSAVQSGVSFMLAAGNSNADACNYSPARVATGVTVGSTTSTDARSSFSNWGSCVDVFAPGSQIKSAWYDGGYKTISGTSMATPHVAGVAALYLQENSSVSPSQVEALIVSRASTGKVTDTRGSVNKLLYSLTDADCGQDCGGPDPTPDPEGKLTSGVPVSGLSGSSGQVAYYYVDVEAGQRLTVQMYGGSGDADLYLRFGAKPTLNAWDCRPFKYGNNETCTVSATQSGRYHVMIQGYSNYSGVSIQANY

SEQ ID NO: 308 - DNA, 1856 bp, Vibrio alginolyticus
  Alkaline serine exoprotease A precursor	S08.050
ctgcagcacgtattgagcataccacgctgattgtctgtgttttcgtgttgacagtttggtactaggtaaaatcaacaagactatgatttcaaggaacattttatgttaaagaaactactaagttgttgtatcacctccgcgctctgttttcattcttctctcgctttttcgcaacccaatgagattgcggacagtgcagagttacaacaagctcccgacacattgcctgccactttgatgcttgcaccggacgacatcgccattgcagatcgatatatagtggtatttcaacaaccgcaaatgatggcgagcagctcaccggaattcgagcaattcacgcaacagtctgtagaccgcatgtccggtttatattcgatacaagtggagtcggtttttgaccactcgatcagtggatttgtcgctaacttgagtcctgagcaactaaaagatctgcgttctgatcctcgtgtggactacattgagcaagacagaatcctatcgcttgacccaatagtctcggcagacgcaaatcaaaccaatgccatttggggactagatcgaatcgaccaacgtaacttgccactcgataacaactacagtgccaactttgatgggactggtgtaacggcttatgttatcgatactggtgtgaacaatgcacatgttgagtttggtgggcgctcggtttctgggtatgactttgtcgataatgatgcagatgcaagtgactgtaatggacacggcacacacgtggcgggcaccattggcggcagcttgtatggtgttgcgaaaaacgtcaaccttgtcggcgtgagagtattgagctgtagcggatcggggtctacgtctggtgttatcgccggtgtggattgggtggctgcgaacgcttccggaccttcagttgccaatatgagtttaggtggcggtcaatctgtcgctctcgatagtgcggtgcaaagtgcggttcaatcaggtgtcagctttatgcttgcagcaggtaactccaatgccgatgcgtgtaactactctccagcgcgcgttgctactggtgtaactgtcggctcgaccaccagcacggatgcacgttcgagtttttcaaactggggcagttgtgtggacgtgttcgcgccaggctcacaaatcaaatctgcgtggtatgacggtggttacaaaaccattagtggtacatcgatggcgacgccacatgtagcgggtgtagcagcactgtatcttcaagaaaacagttccgtgtcgccaagccaagtagaggccttgatcgtgagccgcgcaagtaccggaaaggtgacggacacaagaggcagcgtgaacaagctactttatagcttaacggatgcagattgtggccaagactgcggtggcccagatccaacaccggacccagaaggcaagttaacctcgggcgtgccagtgagcggtttaagtggctcaagcggtcaagtagcgtattactatgttgatgtagaagctgggcagcgcttaaccgtacaaatgtatggtggcagcggtgatgcggatttgtatctccgttttggtgcaaaaccgacactgaatgcatgggactgccgacctttcaaatacggtaacaatgaaacatgtacggtcagcgcgacacaaagtggacgctaccacgtcatgattcaaggttactcaaactatagcggtgtcagcattcaagctaactactagttgttattctcgttactaaaagagaacaaagcccgcttttcggtgggctttgctttcgggaatactaagtttaataggtggcgttcgatgctattcaaacgcaccggcctttttcttcaagaactcaactcgaagcggcatcgaagctt

SEQ ID NO: 309 - protein, 461 aa, Staphylococcus epidermidis
  Epidermin leader peptide-processing serine protease epiP precursor  S08.060
MNKFKFFIVFLILSLVFLQNEYAFGSSLNEELSYYSVEYDNAKTFKESIKQKNIELTYKIPELHTAQIKTSKSKLNSLIKSNKNVKFVNPTCSTCVVEKSVKTGKNLNNKKNGSHDLFDRQWDMRKITNEGKSYKLSPDRKKAKVALVDSGVNSSHTDLKSINKIVNEVPKNGFRGSENDESGNKNFEEDKLNHGTLVAGQIGANGNLKGVNPGVEMNVYRVFGSKKSEMLWVSKGIIDAANDDNDVINVSLGNYLIKDNQNKKKLRDDEKVDYDALQKAINYAQKKGSIVVAAVGNDGINVKKVKEINKKRNLNSKTSKKVYDSPANLNNVMTVGSIDDNDYISEFSNYGNNFIDLMTIGGSYKLLDKYGKDAWLEKGYMQKQSVLSTSSNGRYIYQSGTSLAAPKVSGALALEIDKYQLKDQPETAIELFKKKGIEKEKYMDKKHYGNGKLDVYKLLKE

SEQ ID NO: 310 - DNA, 8700 bp, Staphylococcus epidermidis
  Epidermin leader peptide-processing serine protease epiP precursor	S08.060
agatcttgtgttatataactaaacaaatttctccattcgtatttagaaaattgacttttatcaagtttatccaaatatatatttccagtatattctgtatttaacccagctaatatatttaataatgtactttttccacacccactttcacctataatattgtagatataacctttatgaagatccaaacttatagaatttattatttgtttattgtcttttgtgaagttcaaatcatttatttccattttttgaacaaagttattgtaagttgttttaatagttaatacctcttctggttctttatttatttttaaaattctatctgaagatccaattgctcgttgtacttccgtccaataagatgtaatagatactattggattaataatttgaaataaatataaaacataagcaaacatatctccgcttttcatcatattattttccattaagtaataacccaaaaataaaataccaaaaatgttaataaatagaattaagttcataattggttcgaaaaaagataatactttgatcttatgtaactctatatcgaatatattttttaatagggtatagttttttattttttcgatattatatgtacttaaagtttttattaattttattgtagataatctattactataataagaagataatttagcagtagcttcttgagatttacttgatactcttttcattatatttcctataggtagtattacaattatcaatataggtaatgtacacactaaatataatgtcaaggttttgttaattatatataaaaatattagtgatactataactgaaaataaattctacagaaaaaactctagttatgttcatagtatcgtttactaacctactagttaagttacttgctgagttttttaagtgaaaactataaggtaactttatcactttattccatgtaacacttctaatgttttgtattattttttgacctatatatccaagaatataagtagaaacaccagaaaatattaaagtcagaccaaaacatataataatgattacaattttatctgttgataagctagatttgtttaaggcatttctaattattaaaggaatgtataatgaaaaactagttccaatcaaactaaatattagtccaatacttaaaagtagagtgttaggtttggttattttccataaatcatatagacctttgataatatcatcaccttttaaactttatatcattaatataatgtttaggaaaagtagaagaaaattacacttttgtaattttctgaatatacatagtatttattttgggggagtactaaaataataattgaaaagggttttataatcctttttaataaatttttaggagtgtttaaaatggaagcagtaaaagaaaaaaatgatctttttaatcttgatgttaaagttaatgcaaaagaatctaacgattcaggagctgaaccaagaattgctagtaaatttatatgtactcctggatgtgcaaaaacaggtagttttaacagttattgttgttaattcagaagaattagattggcagggcttcaatagaggctctgtcttaattttgaggtgaaatagaattggataatatatttgttccatcgaatatatatatggtaagaactcctatattttcaattgaattatataatcaattcttaaaatctgacaatatagattatgacttaattttacaaaacgatatttttaaagaatctataatgacaacgacatataatctttatcaaagtattggcaaaatagactgggaaaaggataataaaaaaaccagaaatgtaaaagaaagtttattaaaatatctcataagaatgagtactagaagtacaccatatggaatgctaagcggtgtagctttaggggaatttagtgaaaataataatattaaaattaaggactcttcgtttcataaaaaagatgtaaaaatagatgggcaatggttatataaattagtccattatttagaaagcgattacacatattataaagacagttttgtcatatggaatcaacaaaattatatttataacaatcgtttatatttagataataattcatcaatcactgaaaataaaagaaatgatgtattatctgtcaaatacaattctatattagtgtttatacatgagaattctaaaaaaaatattacttatgaagaacttgtacaattgatatctagtaagtacagtatagaaaataaagaagaagtaaaagtatttgttcaagaactcataaataaagaaattatattttctgatttgagacctacattagagaataaaaatcctttagattacattattaatagtttaaatccaaaaaatagtttagttggaacacttattaatatttctaatgaaattacaaaatattctaaaatgcctttaggaaaaggagaatataaatatttagatattgttaatttaatgtcacaattatttgtttctaaaaactatttgcaaatagatacctatatagattattcaagaaatgaattaaaacaaagtttagctgataatattagtgaagcagcatatattctctggttattatctcctaatcattttggtacaaaaactattaggaattatcacgaattttttatggataaatatggatttgaacaactagtaaatttaaagcaattgctctcagatataaatggatttggctatcccaaaaaagacagttatagtttttctaataacattgcatttttaaaagaaaagtatttgcttgcaattcaaaataacagccatattgaaataacagaaaacgacgttaaaaatttagaaaagaataatacagtttctaaaatcaatgcgcctgtttcaactgaaatatatagtgagatatattttggaaattcaataaaaggttatgaggattttgccgtgataagtccaatattaggatcttttaatgccggtgcaacttttggaaggtttacgggaaatttcaatataaagaaaaaaaatcaattacaaaaagaaatagtgcatcattacaataattacatgaatgaaaatggtttagaaataagccaattaaatgaaggtcctcttaactcaagaaatgtaaatattttgaataataatagaatatataatacttgtttaaatttaaatttacctaaaagtgatatagatataaatgacatatttattggagctacatttaacaaactttatctatattctgaaaaacatgattcaagaattgtattcgtatctaattcaatgtttaattatgagtttggatctgaattatacaaatttttaagagaaatttcatttgaaaaaacaaaatttatacaacctataactgaagaaggcattgactcattacctttttgtccaagaattatttataaaaatattattttaaaaccagctacttggaaaataaattcagaaatgttttctgaaactgaaaattggttaaataggttcgcaactattagagaaaaatggcatattccaaaagatgtaattattgcttttggagataatcgattgctattaaatttattaaatgacaagcatctcattatactaaaaaaagaactaaaaaaacatggtaggattcgaatattagaaagctttatcaatgaatctaataatgagagaatgttagaaattgttacgccattatataaaaaaactagtttaaaagaacaatctttcattatacctaaaaatagaaataagcacttcaataatcttaaagattggttttcaattcatttaagtattcctaaaacataccaagataattttattcaagattatctattaccatttataacggaattaaaagttaataattttattaataaatttttttacataaaatttaaagaagatgaagattttataaaattaagattattaagagaagatgaagattattctcaaatttattctttcataaaaaattggaaagattattgcttattaaatagtgaattatatgactattctatagttgattatgttcctgaagtatatagatatggtggtccacacgtaattgaagatattgagaatttttttatgtatgatagtctattatcaataaatataatacaatcagagttcaaaattccaaaagaatttatcgttgctatatcaatagattttttattagattatttagaaattaataaaagtgagaaagaagaaattttaattaataatgcggaagatttatatcgtagtaatgacataagagaatataaaaatttattagctaaacttaccaatcctaaaaatgactatgaaattttaaaaaaagaatttccgaatcttcatgaatttctatttaataaaattagtattttagaaaatcttaaaaagacactacaaaaaagcttatatacttcacgttctaggataattggcagttttatacacatgcgttgtaatagaatattcggtattaatcctgaaaaagaaaaatttgttttatctatttttaatgaaattacaaaaactaaaaaatattgggatggttgtgattaatattaataacattaaaaaaattttagaaaataaaatcacctttttgtctgacattgaaaaagctacatatattatagaaaatcaaagtgagtattgggatccttatactctatctcatggttatccaggtataatactttttttaagcgcatcagaaaaagtatttcataaagatttagaaaaagtaatacatcaatatattagaaaactaggcccttatttagaaagtggtattgatggattttcactttttagtggtctttccggaattggatttgcgctagacattgcgtctgataaacagtactcttatcaaagtatcttagaacaaattgataatttacttgttcaatatgtttttgattttttaaataacgatgcattggaagtaacccctactaactatgatataatacaaggattttctggtataggaaggtacttgttaaatagaatatcgtataattataatgcaaaaaaagcattaaagcatatacttaattacttcaaaacaattcattactctaaagacaattggttagtttcaaatgaacatcaatttttagatatagataagcaaaattttccgtcaggaaatataaatttaggattagcgcatggtattttaggtcctctatcattaacagctttgagtaaaatgaatgggattgaaatcgaaggccatgaagagtttttacaagacttcacttcatttttgctcaaacctgaattcaaaaataataatgaatggttcgatcgctatgatatattagaaaattatatacctaattattccgtcagaaacggttggtgttacggtgatacagggattatgaatacattacttttgtctggtaaagccttaaataatgaaggcttaattaaaatgtctaaaaatattttaattaacataatagataagaataatgatgatttaatcagtccaaccttctgtcacggactagcatcgcacttaaccattattcatcaagcgaataaattctttaatctatctcaagtaagcacatatatcgataccattgtcagaaaaattattagtcattattctgaagaaagtagttttatgttccaagacatagagtactcatacggacaaaaaatttataaaaacaaagtgggaattctagagggtgaattaggtgttcttttagctttactagattatattgatacacaaaaccaatcaaggaaaaattggaaaaatatgtttttaataacataataggaggaataagatatgtatggaaaattattgatatgcgctacagcatcgataaatgtaattaatattaatcactacatagttgagttaaagcaacattttgatgaagttaatatattatttagtcctagtagtaaaaattttataaatactgatgttctcaagttattttgtgataacttgtacgatgaaattaaagatcctcttttaaatcatatcaatattgtagaaaatcatgaatatattttagtattacctgcatcagcaaatactattaataaaatagctaatggtatatgtgataatcttttaactactgtatgtttaaccggatatcaaaaattatttatatttccaaatatgaacataagaatgtggggaaatccatttttacaaaaaaatattgatttacttaaaaataatgatgtgaaagtgtattcccctgatatgaataaatcattcgaaatatctagtggccgttacaaaaacaatatcacaatgcctaatattgaaaatgtactaaattttgtattaaataacgaaaaaagacctttggattaacaaaggtcttttctaattaaaattttatatccgagtttacgttcattaataatttctatctctttacaattttttaaactatcccttaatcgatggatatatacatttattgtattagaatcaacaaagtcttctgtatcccacactcccttttttaattcctcttttgatacatatcttccaagattaatatataagcaccgtagaatttttaattctatattagaaagattaactaagtaattattaaacacaaattgatggttttcaaagtctataaaatcatcattaacatatttaatatacttttttatttcatttaaaattctacataatattaaacttttgctttcattattttttataatatataaatctatgcctaaactataaaaataacacttcctactatagctagtattacctgttattataactattggaatttttcctataaattcttttaaaaacgtataatactcatcaaacttttcatacacaattataaaatttgggtctatatttgaagaattaattgtaattcttctatctaattctaaaatactttcaataagaatagaatctacctcaccgacaatattaatagaaatcattttattcccttcattctttaagtaatttgtatacgtctagttttccattaccataatgttttttatccatatatttttctttttctatcccttttttcttaaataactctatagctgtttcgggttggtcttttaattgatacttatcaatttctagtgctaaagctccagaaaccttgggtgcagcaagtgatgtccctgattgatatatgtatcttccattagaagaagtacttaaaacactttgtttttgcatatatcctttttctaaccaagcatcttttccatacttatctaaaagtttataagaacctcctatcgtcattaaatctataaaattatttccataattagaaaactcagaaatataatcattatcatcgatggatcctacagtcataacattatttagatttgctgggctatcatataccttttttgatgttttagaatttagatttctttttttatttatttcttttactttttttacattgataccgtcattacccacagctgcaacaacaatactaccttttttttgagcatagtttatagctttctgtagtgcatcgtaatcaactttttcatcatctcttaatttttttttattttgattatctttaattaaataatttcctaaactaacgttgattacatcattgtcatcatttgctgcatcaataattcctttagatacccaaagcatttcacttttctttgagccaaatactcggtatacattcatctctactccagggtttacaccttttaaattaccgtttgctcctatttgtcctgctactaatgtaccatgattcaatttatcttcttcaaaatttttatttcctgattcatcgttttcgctacctctaaaaccatttttaggcacttcattaactatcttatttatactctttaaatctgtatgactactattcacaccagaatctactaaagcaacttttgctttttttctatctggacttagcttataacttttaccttcatttgttatttttcgcatatcccattgtctgtcaaataaatcatggctgccattttttttattatttaaattttttcctgtctttacagatttttcaactacacaagtggaacaggtaggatttacaaacttgacgtttttattactctttattagtgaatttaattttgatttgctagttttaatttgtgctgtatgtagttcaggaattttataagttaactcgatatttttttgtttaatggattctttaaaagtttttgcattatcatattcaacactataataacttaattcttcatttagtgaacttccaaaagcatactcattttgcaaaaaaactaatgacaatattaaaaaaacaatgaaaaatttaaatttgttcatatagcacctctaacatattatttatattaaacattaatttaacacttatgtttttacttttttatttatattatctttaataatgttctgttgcaagatgaaaaatacgaggtatcaaagtaccgatacagcgagtattacactcaattaattaaaaataaaatatgttgtgattaaaatttattttataaaagtatgggcaatttattattattcaagttaaaacaaagagtccgggacataaagtttcagcctcttcgtcctaattaccaaaaaacttactccaaaatccttttttagattggttttttctaatttttt

SEQ ID NO: 311 - protein, 1052 aa, Cricetulus griseus
  Site-1 protease (Subtilisin/kexin-isozyme 1) S08.063
MKLINIWLLLLVVLLCGKKHLGDRLGKKAFEKASCPSCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKFAESDPIVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRVKPDIVTYGAGVRGSGVKGGCRALSGTSVASPVVAGAVTLLVSTVQKRELVNPASVKQALIASARRLPGVNMFEQGHGKLDLLRAYQILSSYKPQASLSPSYIDLTECPYMWPYCSQPIYYGGMPTIVNVTILNGMGVTGRIVDKPEWRPYLPQNGDNIEVAFSYSSVLWPWSGYLAISISVTKKAASWEGIAQGHIMITVASPAETEAKNGAEHTSTVKLPIKVKIIPTPPRSKRVLWDQYHNLRYPPGYFPRDNLRMKNDPLDWNGDHVHTNFRDMYQHLRSMGYFVEVLGAPFTCFDATQYGTLLMVDSEEEYFPEEIAKLRRDVDNGLSLVIFSDWYNTSVMRKVKFYDENTRQWWMPDTGGANIPALNELLSVWNMGFSDGLYEGEFALANHDMYYASGCSIAKFPEDGVVITQTFKDQGLEVLKQETAVVENVPILGLYQIPAEGGGRIVLYGDSNCLDDSHRQKDCFWLLDALLQYTSYGVNPPSLSHSGNRQRPPSGAGLAPPERMEGNHLHRYSKVLEAHLGDPKPRPLPACPHLSWAKPQPLNETAPSNLWKHQKLLSIDLDKVVLPNFRSNRPQVRPLSPGESGAWDIPGGIMPGRYNQEVGQTIPVFAFLGAMVALAFFVVQISKAKSRPKRRRPRAKRPQLTQQTHPPRTPSV

SEQ ID NO: 312 - DNA, 4198 bp, Cricetulus griseus
  Site-1 protease (Subtilisin/kexin-isozyme 1) S08.063
tgttcgcggcagaggcgccgttcccccgggcccgccgacctcgagcctgaggcggacgcaggtcggccctcagagtggtttcttgggcatccccactagatttgggtctgtggtgcaaatggagtctaggactcagtcgactctgccctaatgagagaagcccctgtccaagatggagaagaagcggagaaagaaatgaaagcctctttttgggccaagctgtgggtgaccatgggactgaggttttctttacgttggacaagtctgtaggatggctgatcagtaaggttgcagcttttagccaaaacagaaattcacttctgatcaaggaagaacctagtgcgatttgaatttatgcaattttatgaccatattcacttaggaccatgaagctcatcaacatctggcttcttctgctggtggttttgctctgtggaaagaagcatctgggtgacaggctggggaagaaagcgtttgaaaaggcatcatgccctagctgttcccacctgactttgaaggtggaattctcctcaactgtggtggaatatgaatatattgtggctttcaacggatacttcacagccaaagctagaaactcatttatttcaagtgctctgaaaagcagtgaagtagacaactggagaattatacctcggaacaacccatccagtgactaccctagtgattttgaggtgattcagataaaagagaagcagaaggccgggctgctcacacttgaagatcatccaaacatcaagcgggtgacacctcaacgcaaagtctttcgttccttgaagtttgctgaatctgaccccattgtgccatgtaatgaaactcggtggagccagaagtggcagtcatcacgacccctgagaagagccagtctctccctgggctctggattctggcatgcaacaggaagacattcaagccggcgattgctgagagccattcctcgacaggttgcccagacattgcaggcagatgtgctgtggcagatgggatacacaggtgctaatgtcagggttgctgtttttgatactgggctcagtgagaagcatccacacttcaagaatgtgaaggagagaaccaactggaccaatgagcggaccctggatgatgggctgggccatggcacatttgtcgcaggtgtgattgccagcatgagggagtgccagggatttgccccagatgcagagctgcacatcttccgggtctttaccaacaatcaggtgtcttacacatcttggtttttggacgctttcaactatgccatcctaaagaagattgatgttctaaaccttagcatcggcgggcctgacttcatggatcatccctttgttgacaaggtgtgggaattaacagctaacaatgtaatcatggtttctgctatcggcaatgatggacctctttatggcactctgaataacccagctgatcagatggatgtgattggagtgggtggcattgactttgaagataacatcgcccgcttttcttccaggggaatgactacctgggaactaccaggaggctatggtcgcgtgaaacctgacattgtcacctatggtgccggagtgcggggttccggtgtgaaagggggctgccgggcactctcagggaccagtgtcgcttccccagtggttgctggggctgtcaccttgttagtaagcacagtgcagaagcgggagctagtgaatcctgccagtgtgaagcaagccctgattgcatcagcccggaggcttcctggtgttaacatgttcgagcaaggccatggcaagctggatctgctgcgagcctatcagatcctcagcagctacaaaccacaggcgagcttgagtcctagctacatcgacctgactgagtgtccctacatgtggccttactgttctcagcccatctactatggaggaatgccaacaattgttaatgtcaccatcctcaatggcatgggagtcacaggaagaattgtggataagcctgagtggcggccctatttaccacagaatggagacaacattgaagtggccttctcctactcctcagtgttatggccttggtcaggctacctggccatctccatttctgtgaccaagaaggcagcttcctgggaaggcattgcacagggtcacatcatgatcacggtggcttccccagcagagacggaagcaaaaaatggtgccgagcatacttccacagtgaagcttcccattaaggtgaagatcattcccacccctcctcggagcaagagagtcctctgggaccagtatcacaacctccgctaccccccaggctactttcccagggacaacttgcggatgaagaatgatcctttagactggaatggcgaccatgtccacaccaatttcagggacatgtaccagcacctgcgcagcatgggctacttcgtggaggtgctcggtgccccattcacgtgctttgatgctacacagtatggcactttgctcatggtggatagtgaagaagagtacttcccagaggagattgccaagctgaggagggacgtggacaatggcctttccctcgtcatcttcagtgactggtacaacacttctgttatgagaaaagtgaagttttacgatgaaaacacaaggcagtggtggatgccagatactggaggagccaacatcccagctctgaacgagctgctgtctgtgtggaacatggggttcagcgatggcctttatgaaggggagtttgccctggcgaatcatgacatgtattatgcatcgggatgcagcatcgccaagtttccagaagatggtgttgtgatcacacagactttcaaggaccaaggattggaggtcttaaaacaagagacagcagttgttgaaaatgttcccattttggggctttatcagattccagctgaaggtgggggccggatcgtgttgtatggagattccaattgcttggatgacagtcacagacagaaggattgcttttggcttctggatgcactccttcagtacacatcatatggcgtgaaccctcccagcctcagccattcagggaaccggcagcgcccacccagtggagctggcttggcccctcctgaaaggatggaaggaaaccaccttcatcgatactccaaggttcttgaggcccatctgggagacccaaaacctcggcctcttccagcctgtccacacttgtcatgggccaagccacagcctttgaatgagactgcgcccagtaatctttggaaacatcagaagctgctctccattgacctggacaaagtagtgttacccaactttcgatcgaatcgccctcaagtgagacctttgtcccctggagaaagtggtgcctgggacattcctggagggatcatgcctggccgctacaaccaagaggtgggccagaccatccctgtctttgccttcctcggagccatggtggccctggccttctttgtggtacagatcagcaaggccaaaagccggccgaagcggaggaggcccagggcaaagcgtccacagcttacacagcagacccacccaccaaggaccccgtcagtgtgatcatcacagtggccagccacagaagccaacaagccttggaccactctgatggccacacagggcatcagaagagcatcctgggaggtgcctatttccaagggaccccatctccagcttgtggctgggttagtgtgttctccccaggcatctctgagttacatcctgaagtacctcactgtgctgggctcttgacaggaggtgctcagtagctcagcctccagtggtgtcagcaggcccagtgacagtgcaccaaagacacagagcctggaagggctgtcgggacacactttctacataaagcttacaatcctgaccaagcgaagaaatgcttgttacaggctattttctatatttattgtggggagagtcactttaaagacttgtactgtttggaagcaaagctgttgtgtttgtcagttgagtgcagttttctgcagtgacatcataaggagtcagatcccatgacctttttgatgagaggacagactgaactgaagggcatgtgcacagatctgggaaatgcaagccttcgctttatttttataagtatcaactgccatcatgttttgtaatttggggtcttgatttcaccattgttggtgaaagaaattttcaataaatatgcataaccttaaaaaaaaaaaaaaaaaaaa

SEQ ID NO: 313 - protein, 409 aa, Hypocrea lixii
  Alkaline proteinase precursor (ALP) S08.066
MTSIRRLALYLGALLPAVLAAPAALHKKPEAVPNKFIVTLKEGASIDTDSHLAWVTDIHTRSLTKRSTAGVEKTYNIHTWNAYAGEFDEETIEQIKSNPDVASVEPDYIMHLSDIVEDKRALTTQSGAPWGLGTVSHRTSGSTSYIYDSSAGAGTFAYVVDSGINTSHQQFGGRASLGYNAAGGQHVDTLGHGTHVSGTIGGSTYGVAKQASLISVKVFAGESASTSVILDGYNWAVNDIVSKSRASKSAINMSLGGPASSTWTTAINAAFNQGVLTIVAAGNGDSLGNPQPVSGTSPANVPNAITVAALDINWRTASFTNYGAGVDVFAPGVNILSSWIGSNTATNTISGTSMATPHVVGLALYLQSLEGLTSPTAVTNRIKALATSGRVTGSLNGSPNVIIFNGNSS

SEQ ID NO: 314 - DNA, 1458 bp, Hypocrea lixii
  Alkaline proteinase precursor (ALP)	S08.066
ctcctccactatacaaagcacatcacagccatgaccagcattcgtcgtctcgctctctatcttggagctttgctcccggctgtcctcgctgctcctgcagctcttcacaagaagcctgaagccgtacccaacaagttcatcgtcactcttaaagagggtgcttctattgataccgactctcatctcgcctgggtaacggacatccacacccgttcgttgaccaagcgtagcactgctggtgttgaaaagacttataacattcatacttggaatgcttatgcgggcgagtttgacgaggagacaattgagcagatcaagtccaaccccgatgttgcgtctgttgagccagactacatcatgcatctgtcggacattgttgaagacaagcgtgctctgaccacacaatctggtgctccttggggtctcggcactgtgtcccatcgcacatctggatccacaagctacatttatgatagctcagccggcgccggcacctttgcctatgtggttgactctggtatcaacacttctcatcagcaattcggcgggcgtgccagccttggctacaatgctgcaggaggacagcatgtcgatactcttggccatggtactcatgtttccggaacaattggtggatctacatacggtgttgctaagcaggcgagcctaatctctgtcaaggtctttgctggtgaaagtgcttccacctctgttatccttgacggctataactgggctgtaaacgacatcgtctcgaaaagccgtgctagcaagtctgctattaacatgtcgcttggaggacctgcctcatctacctggacgaccgccattaacgcagcctttaaccagggcgtgcttaccattgtcgccgctggtaatggcgactctctgggaaacccccagccagtctccggcacttctcctgctaacgttcctaacgccataaccgttgccgcattggacatcaactggcgcactgcttccttcaccaactatggtgctggcgttgatgtttttgcccctggcgtcaacattctgtcgtcatggattggatccaacactgctaccaacacaatcagcggtacttccatggctacacctcacgttgttggcctggccctctatcttcaatctctcgagggtctcacctctccgaccgctgtcactaaccgaattaaagctctggctacatctggtcgtgtaaccggaagcctcaacggcagccccaacgttatcatcttcaacggaaacagttcttaaatcgttgatggagcgaaggatgaagtgaaatgttcatggaagggcagcacagctgttgcttggcttgcttagctcatttaagaagctaatcaccatgatggagtgcgatgggtatataagcttctacagcgttttcaacttagctagatgaccctctatagatcgctaaaacaaaaagatatgacagatacctgtgct

SEQ ID NO: 315 - protein, 1045 aa, Serratia marcescens
  Extracellular serine protease precursor  S08.094
MILNKRLKLAYCVFLGCYGLSIHSSLAAYQDPGRLGAPDSWKTAEFNRQWGLEAISAEFAYARGYTGKGITIGVIDNAILSHSEFSGKLTRLDNGSYNFSYDKQDNMSFGDHGTHVAGIAAAKRDGAGMHGVAFDADIIGTKLNDYGNRNGREELIQSAARVINNSWGIAPDIRRDAKGDIIWLPNGRPDYVAFVKSEVIAEMMRSKSSVEWGSEQPVPTGGHSAMSTLLRAARHGKLIVFSAGNYNNYNIPEAQKSLPYAFPDVLNNYLIVTNLSDENQLSVSSTSCGQTASYCVSAPGSDIYSTVGRLESNTGGAVNREAYNKGELSLNPGYGNKSGTSMAAPHVTGVAAVLMQRFPYMSADQISAVIKTTATDLGVAGIDNLFGWGRVNLRDAINGPKMFITKEDIPQEYYVPGSYSEKQFVVNIPGLGNIVEPGTPVERRCTSSECSFDSWSNDISGHGGLTKTGAGTLALLGNNTYRGDTWVKQGVLAIDGSVASNVYIENSGTLSGEGTVGAFRAARSGSVAPGNGIGTLHVLHDAIFDRGSQYNVEVADNGRSDKIAARRAFLNGGSVNVSLERSQNLLSQNEAQSLLGNKYTILTTTDGVTGRFENANPSYPFVKVALDYRGNDVGLGITRTDASFDSLASTENEKAVARAVETLNATEPVTETAKRSVAIPAAEEANLLQSDGGEAQAVNEEASIVAGHPIYESFLGFTSARELQQATRQLSGQIHADMASAQINESRYLRDTATERLRQAEGRRTATDIKADDNGAWAKLLGSWGHASGNDNATGYQTSTYGVLLGLDSELFGDGRLGMMTGYTRTSLDGGYQSDAHSDNYHLGLYGDKRFGALALRAGGTYTWHRIDTSRSVNYGAQSDREKAKYNARTGQLFIESGYDWTSDAVNLEPFANLAYTHYRNEEINEQGGAAALRGDKQSQSATASTLGLRADTEWQTDSVAIALRGELGWQHQYGKLERKTQLMFKRTDAAFDVNSVPVSRDGAILKAGVDVSINKNAVLSLGYGGQLSSNHQDNSVNAGLTWRF

SEQ ID NO: 316 - DNA, 3675 bp, Serratia marcescens
  Extracellular serine protease precursor	S08.094
gatccttacgcccggtcccgatggtcggtcattccggcgcaacgggcgaaacgtacattcgcctcctctccagacgtcctgcgccatagccgcggcgcgatggcatccctttgtctgtccgcgcccatttgcatctctcagcatgtctgttcgtgcggcccgcgccgggtccgcatgtgttatccgtcgtttcacgatcataggaggtttcagcgcggttaaaacgtaagttttcttctgggtataaataaacatggagcgtaaaatgatacttaataaaagattgaagttagcgtattgcgtttttctgggttgttatggcttatccattcattcttctcttgccgcttatcaggatcccggtcgattgggcgcgcctgacagttggaaaaccgcggagtttaatcgccaatgggggcttgaagctatttccgccgaattcgcctatgccagaggctataccggaaaaggtataaccatcggcgttatcgataacgctattctttcccattctgaattctccggtaaactgacgcgcctggataacggcagttataatttctcgtatgataaacaagataatatgtctttcggcgatcacggcacgcacgtagccggtatcgctgcggctaaaagagatggcgcaggcatgcacggcgtcgctttcgacgcggatattatcggcaccaaattgaatgattacggtaatcgcaacggccgtgaagagctgattcagagcgcggctcgcgtcatcaataacagctgggggatcgcgccggatatccggcgagacgccaaaggcgatatcatctggttgccgaacggcaggccggactacgtggcattcgtaaaaagcgaagtgatcgccgagatgatgcgcagcaaatccagcgtggaatggggcagcgaacaaccggtgcccaccggcgggcacagcgccatgtcgacgctgctgcgggcggccaggcacggcaagctgatcgtcttctcggcgggcaattacaacaattacaatattccggaagcgcaaaagtcactgccttacgctttcccggacgtactgaataattacctgattgtgaccaacctgagtgacgaaaatcagttaagcgtttcctcgaccagctgcgggcaaacggccagctattgtgtttccgcgccgggttctgatatttacagcaccgtcggccggctggagtccaataccggcggcgccgtgaatcgcgaagcttataataagggcgagctgtcgcttaatcctggttacggcaacaaatccggcacctcaatggcggcgccgcatgtgaccggcgtcgccgccgtattgatgcagcgcttcccatatatgagcgccgatcaaatatctgcagtcattaaaaccaccgccaccgatttaggcgttgccggcattgataatttattcggctgggggcgcgtcaatttacgcgatgcgatcaacggcccgaaaatgtttattaccaaagaggatatcccgcaggaatattatgtgccgggttcctacagtgagaaacagtttgtggtgaatatccccggcctgggaaatatcgtcgaacccggcacgccggttgagcggcgctgcacgtcgagcgaatgcagtttcgattcgtggagtaacgacatcagcgggcacggcggcttgaccaaaacgggcgccggtacgctggcgctgttgggtaataacacctatcgcggtgatacctgggtgaaacagggcgtgttggcgatcgacggttcggtggcatccaacgtctatatcgaaaatagcggcacattgtccggcgagggcaccgtaggcgccttcagagcggctcggagcggcagcgtcgcgccgggcaacggcatcggcacgctgcatgtgttgcacgatgccatttttgatcgcggttcgcagtataacgtggaagtggcggacaatggccgcagcgataagatcgccgcgcggcgcgctttcctcaacggcggcagtgtgaatgtcagcctggaacgcagccaaaacctgctgtcgcagaatgaggcgcagagtctgctgggcaacaagtacaccatcctgaccacgacggacggcgttaccggtagattcgaaaacgccaacccatcgtatccgtttgttaaagtcgcgctggattatcggggcaatgacgtcggccttggcatcacgcgcaccgacgccagctttgacagcctggccagcactgagaacgagaaagcggtagctcgtgcggtggagacgctcaacgcgacggaaccggtcacggaaacggccaaacgcagcgtggcgatcccggcggccgaagaggccaacctgctgcaaagcgatgggggcgaggcgcaagccgtgaacgaagaggcgagcatcgtggcgggccatccgatctatgaaagcttcctcggcttcacctcggccagagaattgcaacaggcgacccgtcaactgtccggccagatccacgcggatatggcttccgcccagatcaacgaaagccgttacctgcgcgataccgccaccgagcgcttgcgccaggcggaaggccgccgcaccgctaccgacattaaagcggatgacaacggcgcctgggcgaaactgctgggtagctgggggcatgcttccggcaacgacaacgccaccggttaccagacctccacctatggcgtgctgttaggtctggacagcgaactgtttggcgacggccggcttggcatgatgaccgggtatacccgcacttcgctggatggaggttatcagtcagatgctcacagcgacaactaccatctggggctgtacggcgacaaacgcttcggcgcgttggcgctgcgagcgggcggcacctatacctggcatcgcatcgacacctcgcgttcggtgaactacggcgcgcagtcggatcgcgagaaggccaagtataacgcgcgcaccggtcagctgttcatcgaaagcggctacgattggacgagcgatgcggtcaaccttgagccgttcgccaacctggcgtatacccattaccgtaacgaggagatcaacgagcaaggcggggcagcggcgctgcgcggcgacaaacaaagtcagtccgccaccgcctcgacgttgggtctgcgcgccgacaccgagtggcaaaccgacagcgtggcgatcgcgctgcgcggcgagctgggttggcagcatcagtacggcaagctggagcgtaaaacgcagctgatgttcaaacgcactgatgcggcgttcgacgtgaacagcgtgcctgtttctcgcgatggcgcgattctgaaagcgggcgtcgatgtatcgattaacaaaaacgccgtcctgtcccttggctacggcgggcagctgtcgtccaaccaccaggacaacagcgtcaacgccggtctgacctggcgcttctgatcgcggttgcatgctttgctttattcagccctcatcgagacgatgggggcttttttttcgcggccagccggccttctgcggcatgagcgatactttctccgcgacctattcccccggccggtgttcgccgccgggttaatcaatcagaggaaaacaaacgctgctgccaatagcgcaattgcgtcagcgtgatcggcgcagcggcggcaatgaccgcgcgattttccaacgcaatctcccgcgcacgttgcaacggctcggcgctgaggcct

SEQ ID NO: 317 - protein, 1441 aa, Drosophila melanogaster
  Tripeptidyl-peptidase II (TPP-II) S08.090
MFNRFRLVHKQLRLYKNFGLLGQKASVGLTLPIISLSRPYMAYMGTERSVVMITAPATKEFAESSERSNSSKKTTNKEQSDKSAESRMATSGIVESFPTGALVPKAETGVLNFLQKYPEYDGRDVTIAIFDSGVDPRATGLETLCDGKTVKVIERYDCSGCGDVDMKKKVTPDENGNIKGLSGNSLKLSPELMALNTDPEKAVRVGLKSFSDLLPSKVRNNIVAQAKLKHWDKPHKTATANASRKIVEFESQNPGEASKLPWDKKILKENLDFELEMLNSYEKVYGDIKTSYDCILFPTADGWLTIVDTTEQGDLDQALRIGEYSRTHETRNVDDFLSISVNVHDEGNVLEVVGMSSPHGTHVSSIASGNHSSRDVDGVAPNAKIVSMTIGDGRLGSMETGTALVRAMTKVMELCRDGRRIDVINMSYGEHANWSNSGRIGELMNEVVNKYGVVWVASAGNHGPALCTVGTPPDISQPSLIGVGAYVSPQMMEAEYAMREKLPGNVYTWTSRDPCIDGGQGVTVCAPGGAIASVPQFTMSKSQLMNGTSMAAPHVAGAVALLISGLKQQNIEYSPYSIKRAISVTATKLGYVDPFAQGHGLLNVEKAFEHLTEHRQSKDNMLRFSVRVGNNADKGIHLRQGVQRNSIDYNVYIEPIFYNDKEADPKDKFNFNVRLNLIASQPWVQCGAFLDLSYGTRSIAVRVDPTGLQPGVHSAVIRAYDTDCVQKGSLFEIPVTVVQPHVLESDQNTPVFEPASSKGDNSVEFQPNTIQRDFILVPERATWAELRMRITDPNRGEDIGKFFVHTNQLLPKQSCRKLETMKIVSVGSENESIMAFKVKSGRILELCIAKYWSNYGQSHLKYSLRFRGVEAHNPNAYVMHAGRGIHKLEIEALVAEDVQPQLQLKNAEVVLKPTEAKISPLSATRDVIPDGRQVYQNLLAFNLNVAKAADVSIYAPIFNDLLYEAEFESQMWMLFDANKALVATGDAHSHTSFTKLDKGEYTIRLQVRHEKRDLLEKISEANLVASFKLTSPLTLDFYENYNQCIVGGRKYVSSPLRLSTRVLYIAPITQERLTKANLPAQCAWLSGNLVFPQDEVGRRVAQHPFTYILNPAEKKSHTNGSSNGSSAAGSTATAAAVTTANGAKPKAPATPQAATSVTNPAAGDGISVQNDPPVDSSGSPASPKKGKANADDYAESFRDFQCSQIVKCELEMAEKIYNDVVAAHPKHLQANLLLIQNIESNQLKSQLPLTFVNAQKTSPPEAGESADKQKEDQKKVRSALERIVKLADKVIQETDSEALLSYYGLKNDTRADAAKIKTNMDKQKNTLIEALSKKGIAVAKLAVLDDCIKDSLAEINELYTEIIKFVDANDSKAIQFALWHAYAHGHYGRMYKYVVKLIEEKRTRDHFVELAAINGALGHEHIRTVINRMMITAFPSSFRLF

SEQ ID NO: 318 - DNA, 4309 bp, Drosophila melanogaster
  Tripeptidyl-peptidase II (TPP-II)	 S08.090
ggcccgagtaccaatccgattcttcattgaacagctacgaaggaattcgcagagagttctgagcgcagcaatagcagcaagaagactaccaacaaagagcagagcgacaaatcagcggagagcaggatggccaccagcggtattgtcgagtcatttcccacgggcgcactggtgcccaaggcggagacgggagtcctgaactttctgcagaagtacccggagtacgatggacgcgacgtcaccatagccatcttcgattccggcgtcgatccccgggcaacgggactggagacgctgtgcgatggaaagaccgttaaagtaatagagcggtacgactgttccggatgcggcgacgtggacatgaagaagaaggtgacgccggacgagaacggcaacattaagggcctgtccggaaactcgctcaagctgagtccggagctgatggctctgaacacagatccggagaaggcggtgcgggtaggcctcaagagcttcagcgatttgttgccctccaaggtgcggaacaacattgtggcccaggccaagctgaagcactgggacaagccgcacaagacggccactgcaaacgccagtcgcaagattgttgaatttgagtcacaaaatccaggagaagcctcaaaactgccctgggacaagaagatattgaaagagaatctagactttgagctagagatgttgaatagctacgagaaggtgtacggcgacattaagacctcctacgattgcatcctttttcccacggccgacggatggctgacaatcgtcgacaccacggagcagggcgatctggatcaggctctgcgcattggcgagtattcccgcacgcacgagacccgcaatgtggacgactttctttccatatcggtaaacgtccacgacgagggcaacgtactggaggtggtcggcatgagctcaccccacggcacccacgtatcgtctattgccagcggcaaccatagctcccgggacgtggatggcgtggcgccgaatgctaagatcgtttctatgaccatcggtgatggtcgacttgggtctatggagaccggcacggcactagtgcgtgccatgactaaggtgatggaactatgtcgcgatggcagacgcatcgatgtgatcaacatgagctatggcgagcatgccaattggtcaaattccggccgcattggggagctcatgaacgaggttgtcaacaagtatggcgtggtgtgggtggcatcggccggcaaccatggtccggcactttgtactgtgggaactccgccggacatcagccagcccagtttgatcggcgtgggcgcgtacgtatcaccccaaatgatggaggccgagtatgcgatgcgagaaaagctgcccgggaacgtgtacacctggacatcgcgagatccctgcatcgacggaggtcaaggcgttaccgtatgcgctccgggcggagccattgcgtccgtgccacagtttactatgagcaagtcccagctgatgaacggtaccagcatggcggcacctcacgtcgccggcgcagtggcgctgctcatctccggtctgaagcaacagaacatcgagtattcgccgtacagtattaagcgagcgatcagcgtcactgccaccaaactgggctatgtagatccctttgctcagggccatggcttgctcaatgtcgagaaggcattcgagcatttgacggagcaccgccagtccaaggataatatgctcaggttctccgtgcgcgtgggcaacaacgcagacaagggcattcatttgcgtcagggcgtgcagcgtaactccatcgattacaacgtttatatagagcccatcttctacaatgacaaggaggcggatcccaaggacaagtttaacttcaatgtacggctaaatctgattgcctcgcagccgtgggtgcagtgtggagctttcttggatctcagctatggcacccgctccattgccgtgcgcgtcgatcccactggactccagccaggcgttcacagcgctgtgattcgggcttatgacactgactgcgtacagaagggttctctctttgagattcctgtcacggtggtgcagccccatgtgctggagtcggatcagaacacgcccgtcttcgaacccgcctcttccaagggagacaacagcgtggagtttcagccaaacaccattcaaagagacttcatcctggtgccagaacgtgctacttgggcggagttgcgtatgcgtataaccgatcccaatcgtggcgaggacattggaaagttctttgtacacacgaaccaacttcttcccaagcaatcctgtcgtaagcttgagaccatgaagatcgtatcggttggctcggaaaacgaatctataatggcttttaaagttaagtctggcaggattctggagctatgcattgccaagtactggtccaactacggccagagtcacctgaagtacagcttgcgtttccgtggcgtggaagcgcacaatcccaatgcctacgtcatgcatgcgggcaggggaattcataagctggagattgaggccctggttgccgaggatgtgcagccccagctacagctaaagaatgccgaagtggtgctaaaaccgaccgaggccaagatctcgccgctaagcgccacacgagacgtcatcccagatggacgtcaggtgtatcagaacctgctggcctttaacttgaacgtggccaaggccgcagatgtgtcgatatacgcaccgatctttaacgacttgttgtatgaagcggagtttgagtcacagatgtggatgctttttgatgcaaacaaggccctggtggccaccggcgatgctcactcccacacttccttcacaaagctcgataagggcgaatacacaatcagactgcaggtgcgtcacgagaagcgcgacctgctggagaagatctcggaggcaaatctggtggcctcattcaagctgactagccccctcacccttgatttctatgagaactacaatcagtgcatcgtgggaggtcgtaaatacgtctcgagtccgctaaggctgtccactcgggtgctttatatcgctcctattacccaagagcgacttaccaaggccaatctgcccgctcaatgcgcctggctgagcggcaatctggtattcccgcaagatgaggtcggacggcgagtggctcagcatccatttacttacatcctcaatcccgctgagaaaaagtcacacacgaatggctcgagcaacggttccagcgctgcaggatccacagctacggcagctgctgtcaccactgctaatggcgcaaaaccgaaagctccggcgactccacaagcggccacctcagtgaccaatcctgcggccggcgatggaatttctgttcagaacgacccgcctgtggacagcagtgggagtcccgcctcacccaaaaagggcaaggccaatgccgacgattatgccgaaagttttcgcgactttcaatgttcgcagattgtcaagtgtgaactggaaatggcagagaaaatctataatgatgtagtcgctgcccatcccaagcatttgcaggcaaacctgctacttatccagaacatcgagtccaatcagctgaagtcgcaactgccgctgactttcgtcaatgctcaaaagacatcgccaccagaggcaggcgagagcgccgacaagcaaaaggaggatcaaaagaaagtacgaagcgccctggagcgaattgttaagctggccgacaaggtgatccaggagaccgattccgaggcactgctctcctactacggtctgaagaacgacactcgtgccgatgcagccaagataaagaccaacatggacaaacagaaaaacactctcattgaggcgctaagcaagaagggcattgctgtggcaaagctggctgtattagacgactgtatcaaggatagcctggctgagatcaacgagctgtatacggagattatcaagttcgtggacgccaacgactccaaggccatccagttcggtctgtggcacgcctatgcccatggccactacggtcgcatgtacaagtatgtggttaagctaatcgaggagaagcgaacccgcgatcacttcgtggagctggccgccatcaacggcgccctgggtcacgagcacatccgtactgtcatcaaccgtatgatgatcactgcctttcccagcagcttccgtttgttctgagcactttccgacagaatacgcaacaaatattcacgcttcgaagcgatcattgttttgtataactaatgtaatccatatgtatatgaataaatgctattaactgaaaaaaaaaaaaaaa

SEQ ID NO: 319 - protein, 806 aa, Bacillus subtilis
  Minor extracellular protease vpr precursor S08.114
MKKGIIRFLLVSFVLFFALSTGITGVQAAPASSKTSADLEKAEVFGDIDMTTSKKTTVIVELKEKSLAEAKEAGESQSKSKLKTARTKAKNKAIKAVKNGKVNREYEQVFSGFSMKLPANEIPKLLAVKDVKAVYPNVTYKTDNMKDKDVTISEDAVSPQMDDSAPYIGANDAWDLGYTGKGIKVAIIDTGVEYNHPDLKKNFGQYKGYDFVDNDYDPKETPTGDPRGEATDHGTHVAGTVAANGTIKGVAPDATLLAYRVLGPGGSGTTENVIAGVERAVQDGADVMNLSLGNSLNNPDWATSTALDWAMSEGVVAVTSNGNSGPNGWTVGSPGTSREAISVGATQLPLNEYAVTFGSYSSAKVMGYNKEDDVKALNNKEVELVEAGIGEAKDFEGKDLTGKVAVVKRGSIAFVDKADNAKKAGAIGMVVYNNLSGEIEANVPGMSVPTIKLSLEDGEKLVSALKAGETKTTFKLTVSKALGEQVADFSSRGPVMDTWMIKPDISAPGVNIVSTIPTHDPDHPYGYGSKQGTSMASPHIAGAVAVIKQAKPKWSVEQIKAAIMNTAVTLKDSDGEVYPHNAQGAGSARIMNAIKADSLVSPGSYSYGTFLKENGNETKNETFTIENQSSIRKSYTLEYSFNGSGISTSGTSRVVIPAHQTGKATAKVKVNTKKTKAGTYEGTVIVREGGKTVAKVPTLLIVKEPDYPRVTSVSVSEGSVQGTYQIETYLPAGAEELAFLVYDSNLDFAGQAGIYKNQDKGYQYFDWDGTINGGTKLPAGEYYLLAYAANKGKSSQVLTEEPFTVE

SEQ ID NO: 320 - DNA, 2931 bp, Bacillus subtilis
  Minor extracellular protease vpr precursor S08.114
gagatatccacatgtccacaaactctatctatattttgtatacgaagtatattcctaactatatatatacacaggtttattcacttatacacagggttctgtgtataactccttcgttatacacaaacaaaatccaataaatggtccaaatgacacaaggatttttttgaattttcaagaaatatatactagatctttcacattttttctaaatacaaagggggaaacacattgaaaaaggggatcattcgctttctgcttgtaagtttcgtcttattttttgcgttatccacaggcattacgggcgttcaggcagctccggcttcttcaaaaacgtcggctgatctggaaaaagccgaggtattcggtgatatcgatatgacgacaagcaaaaaaacaaccgttatagtggaattaaaagaaaaatccttggcagaagcgaaggaagcgggagaaagccaatcgaaaagcaagctgaaaaccgctcgcaccaaagcaaaaaacaaagcaatcaaagcagtgaaaaacggaaaagtaaaccgggaatatgagcaggtattctcaggcttctctatgaagcttccagctaatgagattccaaaacttctagcggtaaaagacgttaaggcagtgtacccgaacgtcacatataaaacagacaatatgaaggataaagacgtcacaatctccgaagacgccgtatctccgcaaatggatgacagtgcgccttatatcggagcaaacgatgcatgggatttaggctacacaggaaaaggcatcaaggtggcgattattgacactggggttgaatacaatcacccagatctgaagaaaaactttggacaatataaaggatacgattttgtggacaatgattacgatccaaaagaaacaccaaccggcgatccgaggggcgaggcaactgaccatggcacacacgtagccggaactgtggctgcaaacggaacgattaaaggcgtagcgcctgatgccacacttcttgcttatcgtgtgttagggcctggcggaagcggcacaacggaaaacgtcatcgcgggcgtggaacgtgcagtgcaggacggggcagatgtgatgaacctgtctctcggaaactctttaaacaacccggactgggcgacaagcacagcgcttgactgggccatgtcagaaggcgttgtcgctgttacctcaaacggcaacagcggaccgaacggctggacagtcggatcgccgggcacatcaagagaagcgatttctgtcggtgcgactcagctgccgctcaatgaatacgccgtcactttcggctcctactcttcagcaaaagtgatgggctacaacaaagaggacgacgtcaaagcgctcaataacaaagaagttgagcttgtcgaagcgggaatcggcgaagcaaaggattttgaagggaaagacctgacaggcaaagtcgccgttgtcaaacgaggcagcattgcatttgtggataaagcggataacgctaaaaaagccggtgcaatcggcatggttgtgtataacaacctctctggagaaattgaagccaatgtgccaggcatgtctgtcccaacgattaagctttcattagaagacggcgaaaaactcgtcagcgccctgaaagctggtgagacaaaaacaacattcaagttgacggtctcaaaagcgctcggtgaacaagtcgctgatttctcatcacgcggccctgttatggatacgtggatgattaagcctgatatttccgcgccaggggtcaatatcgtgagcacgatcccaacacacgatcctgaccatccatacggctacggatcaaaacaaggaacaagcatggcatcgcctcatattgccggagcggttgccgttattaaacaagccaaaccaaagtggagcgttgaacagattaaagccgccatcatgaataccgctgtcactttaaaggatagcgatggggaagtatatccgcataacgctcaaggcgcaggcagcgcaagaattatgaacgcaatcaaagccgattcgctcgtctcacctggaagctattcatacggcacgttcttgaaggaaaacggaaacgaaacaaaaaatgaaacgtttacgattgaaaatcaatcttccattagaaagtcatacacacttgaatactcatttaatggcagcggcatttccacatccggcacaagccgtgttgtgattccggcacatcaaaccgggaaagccactgcaaaagtaaaggtcaatacgaagaaaacaaaagctggcacctatgaaggaacggttatcgtcagagaaggcggaaaaacggtcgctaaggtacctacattgctgattgtgaaagagcccgattatccgagagtcacatctgtctctgtcagcgaagggtctgtacaaggtacctatcaaattgaaacctaccttcctgcgggagcggaagagctggcgttcctcgtctatgacagcaaccttgatttcgcaggccaagccggcatttataaaaaccaagataaaggttaccagtactttgactgggacggcacgattaatggcggaaccaaacttccggccggagagtattacttgctcgcatatgccgcgaacaaaggcaagtcaagccaggttttgaccgaagaacctttcactgttgaataagaaaaagccctgccgattcggcagggctttttaaagatcagtcagcaaacgcctcctgcaataagcgatacgatcggagcttatcttcaaaatgatgcgtgatggtcaccaccatgatttcctctgtttcatacgcgttactcaaagctaacagccgctccttaacctgttctttcgtaccaacaatcattcgatttcgattatcagcaattcgtctctgttcataaggagaatacgtattttccgaacagcttcatacgaggactcctctaaggatac

SEQ ID NO: 321 - protein, 1902 aa, Lactococcus lactis subsp. cremoris
  PIII-type proteinase precursor (Lactocepin) S08.116
MQRKKKGLSILLAGTVALGALAVLPVGEIQAKAAISQQTKGSSLANTVTAATAKQAATDTTAATTNQAIATQLAAKGIDYNKLNKVQQQDIYVDVIVQMSAAPASENGILRTDYSSTAEIQQETNKVIAAQASVKAAVEQVTQQTAGESYGYVVNGFSTKVRVVDIPKLKQIAGVKTVTLAKVYYPTDAKANSMANVQAVWSNYKYKGEGTVVSVIDSGIDPTHKDMRLSDDKDVKLTKSDVEKFTDTVKHGRYFNSKVPYGFNYADNNDTITDDKVDEQHGMHVAGIIGANGTGDDPAKSVVGVAPEAQLLAMKVFSNSDTSAKTGSATVVSAIEDSAKIGADVLNMSLGSNSGNQTLEDPELAAVQNANESGTAAVISAGNSGTSGSATEGVNKDYYGLQDNEMVGSPGTSRGATTVASAENTDVITQAVTITDGTGLQLGPETIQLSSHDFTGSFDQKKFYIVKDASGNLSKGALADYTADAKGKIAIVKRGEFSFDDKQKYAQAAGAAGLIIVNTDGTATPMTSIALTTTFPTFGLSSVTGQKLVDWVTAHPDDSLGVKITLAMLPNQKYTEDKMSDFTSYGPVSNLSFKPDITAPGGNIWSTQNNNGYTNMSGTSMASPFIAGSQALLKQALNNKNNPFYAYYKQLKGTALTDFLKTVEMNTAQPINDINYNNVIVSPRRQGAGLVDVKAAIDALEKNPSTVVAENGYPAVELKDFTSTDKTFKLTFTNRTTHELTYQMDSNTDTNAVYTSATDPNSGVLYDKKIDGAAIKAGSNITVPAGKTAQIEFTLSLPKSFDQQQFVEGFLNFKGSDGSRLNLPYMGFFGDWNDGKIVDSLNGITYSPAGGNFGTVPLLKNKNTGTQYYGGMVTDADGNKTVDDQAIAFSSDKNALYNDISMKYYLLRNISNVQVDILDGQGNKVTTLSSSTNRKKTYYNAHSQQYIYYNAPAWDGTYYDQRDGNIKTADDGSYTYRISGVPEGGDKRQVFDVPFKLDSKAPTVRHVALSAKTENGKTQYYLTAEAKDDLSGLDATKSVKTEINEVTNLDATFTDAGTTADGYTKIETPLSDEQAQALGNGDNSAELYLTDNASNATDQDASVQKPGSTSFDLIVNGGGIPDKISSTTTGYEANTQGGGTYTFSGTYPAAVDGTYTDAQGKKHDLNTTYDAATNSFTASMPVTNADYAAQVDLYADKAHTQLLKHFDTKVRLMAPTFTDLKFNNGSDQTSEATIKVTGTVSADTKTVNVGHTVAALDAQHHFSVDVPVNYGDNTIKVTATDKDGNTTTEQKTITSSYDPDMLKKSVTFDQGVKFGTNKFNATSAKFYDPKTGIATITGKVKHPTTTLQVDGKQIPIKDDLTFSFTLDLGTLGQKPFGVVVGDTTQNKTFQEALSFILDAVAPTLSLDSSTDAPVYTNDPNFQITGTATDNAQYLSLSINGSSVASQYEDININSGKPGHMAIDQPVKLLEGKNVLTVAVTDSEDNTTTKNITVYYEPKKTLAAPTVTPSTTEPAQTVTLTANAAATGETVQYSADGGKTYQDVPAAGVTITANGTFKFKSTDLYGNESPAVDYVVTNIKADDPAQLQAAKQELTNLIASAKTLSASGKYDDATTTALAAATQKAQTALDQTNASVDSLTGANRDLQTAINQLAAKLPADKKTSLLNQLQSVKDALGTDLGNQTDPSTGKTFTAALDDLVAQAQAGTQTDDQLQATLAKILDEVLAKLAEGIKAATPAEVGNAKDAATGKTWYADIADTLTSGQASADASDKLAHLQALQSLKTKVAAAVEAAKTVGKGDGTTGTSDKGGGQGTPAPAPGDTGKDKGDEGSQPSSGGNIPTKPATTTSTTTDDTTDRNGQLTSGKGALPKTGETTERPAFGFLGVIVVSLMGVLGLKRKQREE

SEQ ID NO: 322 - DNA, 8115 bp, Lactococcus lactis
  PIII-type proteinase precursor (Lactocepin) S08.116
ttttgaattgtttgcctttaaaacgattcattactctgtcctctctgtcttttttctcaattttacactaaaatagattttttggaaaactttgcaacagaaccagatctatcaactctacttgacgaagagccaatttctaaaagaactggctgttatttcatcttactcggttaagccttaattcgttgtcgcaagcttcttataactatctagcgcatccgcaagatccttgtctttaatcgtcacatgctgattcttcaatacctgactgataacgcgttgcatgatgcttgaatcgcgagaccatttagcgtaaacgctggcagttagcgcctttttactgctagtaaaggtgcctttggcgggatggttaatcattttaataacttcatacccgtctgtcactttgactggggtctgcgtgtagtcaccattttttaatttgtaggcagcatccttaaatgtggcatcgagcgttttattgtttaattcaaaactaatcttcccgccgttatctttagtcgcagtatcaatggaatcagttttcgcaagcatggcaaaatccttgccagctgctaaatcactgataacttgcttagcagtgtcctcgtcgctagttagaatatgttggacagtcactttgggctgataggtcttccaagcggccttgagctggctttcagaaaccttttttaactttttcagtgcaacttcacttaaaaagttggttcgtaggctttccttgaagctactgcgactgaaaccgttttgacttaagaaagcatcgaaattttcgccgtattgttgtttgtagctatcataggcatcattaactgttttagtgctaaccgattttccataggcatgattcaatgcacgataaatgagcatgttagcaagcatggtctttgtcgttggtgactgtttgagttccttgtacaagctactttcagtcaccttgccacctgaataggtcgcaactgtttggtcggtctgatttgactgacaaccgcttagcagcagtaaagcagttgcggtacttgccaataatactttaaggcgcatttttttcttcatcgattcggtctcctctgaaatgcttacagtaaacgttgtgtatttattctagcgatggcaattgagaatttcaattcaaatactcattttctaataagtgctaaaaatttcaaaacatcttagtctgtaaacggctaaataataacgctaaaagttaatttacagataaaaaaattaataagaagattaaaattttcgttgaatttgttcttcaatagtatataatataatagtatataaattatattatataatataatcttaactacatcaagcgtaggctttgatttggttatgaaaacttttggaaagtggaggatattggatgcaaaggaaaaagaaagggctatcgatcttgttacagtaaacgttgtgtatttattctagcgatggcaattgagaatttcaattcaaatactcattttctaataaytgctaaaaatttcaaaacatctatagtctgtaaacggctaaataataacgctaaaagttaatttacagataaaaaaattaatagaagattaaaattttcgttgaatttgttcttcaatagtatataatataatagtatataatattatattatataatataatcttaactacatcaagcgtaggctttgatttggttatgaaacttttggaaagtggaggatattggatgcaaaggaaaaagaaagggctatcgatcttgttagccggtacagtcgctttaggggcgctggctgtcttgccagtcggcgaaatccaagcaaaggcggctatctcgcagcaaactaagggatcatcactcgcaaatacggtgacggctgcgactgctaagcaagcggccactgacacaactgcagcgacaacgaatcaagcgattgctacacagttggcggctaaaggtattgattacaataagctgaataaagttcagcagcaagatatttatgttgacgtcattgttcaaatgagcgcagcgcctgcctctgaaaacggcattttaagaactgattactccagcacggcggagattcagcaggagaccaataaagtgatcgcggctcaggcaagcgttaaagcagctgttgaacaagtcacccaacaaactgccggtgaaagttatggctatgtcgttaacggcttttcaactaaagttagggttgttgatatccctaaactgaaacaaattgccggagttaaaacagtcacattggcgaaagtttattatccgactgatgctaaggcaaactcgatggcgaatgtgcaagccgtatggtccaattacaaatataaaggtgaaggcacagttgtctcggttattgacagtggcattgatccaacacataaagacatgcggctaagcgatgataaagacgttaaactaaccaaatctgatgttgaaaaattcactgataccgttaagcatggccgctattttaattcaaaagtgccatatgggtttaattacgctgataataacgacaccattacagatgataaggttgacgaacaacacggcatgcatgttgctgggatcatcggtgctaacgggacaggtgacgatccagccaagtctgttgtcggagttgcaccagaagcacagctactggcaatgaaagttttcagcaactctgacacttctgcaaaaaccgggtcagctaccgtggtttctgccattgaagactcggcaaaaatcggtgccgatgtcctcaacatgtccttaggatctaattcaggcaaccaaaccttggaggatccagaacttgctgcggtgcaaaatgctaacgaatcaggaacagccgccgtcatttctgctgggaactcaggaacatccggttcagcaactgaaggcgtcaacaaagattattacggtttgcaagacaatgaaatggtgggatcgccagggacatcacgaggagcgaccacagttgcttccgctgaaaacacggatgtcatcactcaggcagtgaccattacagatggtacaggtttacagcttggaccggaaaccattcagctttcaagccacgatttcactggtagctttgaccaaaagaagttttatattgttaaagatgctagtggcaacctcagcaaaggggcattagccgactatactgctgacgctaaaggcaaaattgccatcgttaaacgtggcgaatttagctttgatgacaaacaaaaatacgcccaagccgctggtgctgctggcttgatcattgtcaacaccgatggcacagcaacaccgatgacttctattgcgttaaccaccaccttcccaacatttgggctctccagtgtaaccggtcaaaagctggttgactgggtcacagcacacccggatgatagtctcggtgtcaagattaccctggcgatgttaccaaatcagaaatatactgaagacaagatgtctgacttcacatcctatgggccagtttccaatctttccttcaaaccagatattaccgcaccaggcggcaacatctggtcaacgcaaaacaacaatggctacacaaatatgtctggtacgtcaatggcctcgccatttattgccggttcacaagcattgttgaaacaagcattgaataacaaaaacaacccattttatgcttactacaaacaacttaaagggacagcgctcaccgattttcttaagacagttgagatgaatactgcccagccaatcaacgatattaactacaataatgttatcgtatcgccgcggcggcaaggggccggtctggttgatgtgaaggcagccattgatgcattagaaaagaatccgtcaacggttgtcgccgaaaacggctacccggcagttgaattgaaagacttcacgagtacggacaagacctttaaactcaccttcacgaatcgcacgacccatgaactaacctatcaaatggacagtaatacggatactaatgccgtttatacatcagcgactgaccctaattctggggttttgtatgacaagaagattgatggagcagccattaaagctggcagtaacataactgtgcctgctgggaaaacggcgcagattgaattcacactatctttgccgaagtcttttgaccaacagcaatttgttgaaggttttctgaactttaagggtagcgatggatcgcgcttgaacttgccatacatgggcttttttggtgactggaatgacggtaagattgtcgatagtctcaatgggatcacttatagtcctgctggtggtaattttggcaccgtgccactattgaaaaacaaaaatacaggcactcaatattatggcggcatggtcacagacgctgatggcaacaagacagttgacgatcaggcgattgctttttcgagtgacaagaatgccttatataatgacatcagcatgaagtattatctattgcgcaatatcagcaacgtccaagttgatattcttgatggtcagggcaataaagttacgactctcagcagttccaccaatcggaagaagacctattataatgctcattcgcagcagtacatctactacaatgctccagcgtgggatggcacctattatgatcaacgtgatggcaacatcaagacggctgatgatggcagttatacttatcgtatttccggtgtaccggaaggcggcgacaaacgtcaagtgtttgatgtgcctttcaagctcgactctaaggcgccgacagttcgtcatgtcgctttgtcagccaaaacggaaaatgggaaaacccagtattatttgacagctgaagccaaggatgatttgagtggtcttgatgccaccaagagcgttaaaactgaaattaatgaagtgacgaatcttgatgctacctttaccgatgctgggacaacggctgatgggtacaccaaaattgaaacgccattatctgatgaacaggcccaagcacttggcaatggcgacaattcggctgagctgtacttgactgataatgcatccaatgccactgatcaagatgccagcgttcagaagccggggtctacatcgtttgatttaattgtgaacggcggcggtatcccagacaagatctcaagtaccacaaccggctacgaagccaatactcaaggtggcgggacgtatacgtttagtggaacgtatccagcagcggttgacggtacttacactgatgcacaaggaaagaaacatgatttgaacacaacctacgatgctgcgactaacagtttcactgcctcaatgccggtcacgaatgctgattacgccgcgcaagtggatctatatgccgataaggcgcatacccagttgcttaaacattttgacaccaaagttcggctgatggcgccaacctttactgatttgaaattcaacaatggctcggatcagacctctgaagcgaccatcaaggttacagggacggttagtgctgacaccaagacagttaatgttggccacaccgtagcagcacttgatgcacaacatcactttagtgttgatgtaccggttaattatggtgacaataccatcaaggtgaccgccaccgacaaagatggcaacaccacgacggagcaaaagacgattacctcgtcttatgatcctgatatgttgaagaagtctgtgacgttcgatcaaggtgtgaaatttggtaccaataaattcaatgccacctcggctaagttctatgaccctaagaccgggattgcgacgattactggtaaggtcaagcacccaacgacaacgttgcaggttgatggtaagcaaattccaatcaaggatgatctgactttcagtttcactttagatttaggtactcttggacaaaaaccgtttggggttgttgtgggtgacaccactcaaaacaaaaccttccaagaagcgttgtccttcattttggatgcagtggctccaacattgtcattggatagctcgacagatgcaccggtttataccaacgatccaaacttccagattaccggaacggccactgacaatgcgcaatatctgagtctgtcaattaacggcagttctgtcgccagccaatacgaagacatcaacatcaatagcggcaaaccaggtcatatggctattgatcagcccgttaaattgctcgaaggcaaaaacgtgctgactgttgctgttacagatagcgaagacaacaccacgaccaagaacatcacagtttactacgaaccaaagaaaacactggcagcaccaactgtgacgccaagtaccactgaaccagcccaaacggtgactctgacggcaaacgctgccgcaacgggcgaaacggttcagtatagtgctgatggtggcaagacatatcaggatgttccggcagccggtgtcacgatcacggcaaatggcaccttcaagtttaagtcgactgatttatacggtaatgaatcaccagccgtcgactatgttgtcaccaatatcaaggccgatgatcctgcacaattgcaggcagctaagcaggaactgactaatctgattgcttccgccaaaacgctaagtgccagcggtaagtatgatgatgccacaacgactgctttagcagcggcaacgcagaaggcacaaacggcgcttgatcagacgaacgcctcagttgattcacttactggtgccaatcgagacctgcaaactgcgatcaatcaattagctgccaagttacctgcagataagaagacttcgctgcttaaccagttgcaatctgtgaaggatgcgctgggaacggacttgggcaatcaaactgatccaagcactggcaaaacatttacggcagcgttagacgacctagtggcacaagctcaagcaggcacgcaaacggacgaccagcttcaagcaactcttgccaagatacttgatgaagtattagcaaaacttgcggagggtattaaagcggcaacaccggctgaggttggcaatgctaaagatgctgcaactggcaaaacttggtatgccgacattgctgacacattgacgtctggtcaagccagtgctgatgcgtctgacaagcttgcacatttacaagctttgcaaagtctgaaaacgaaggtggcagctgccgttgaagcggccaagacagttggtaaaggcgacggtacaaccggtactagcgacaaaggcggcggtcaaggtaccccggcgcccgctccaggcgacacaggtaaggacaaaggagatgagggcagccagcctagttctggcggtaatatcccaacaaagccagccacaacgacgtcaacgaccacggatgatacgactgatcgtaatggtcaacttacatccggtactagcgacaaaggcggcggtcaaggtaccccggcgcccgctccaggcgacataggtaaggacaaaggcgatgagggcagccagcctagttctggcggtaatatcccaacaaatccagccacaacgacgtcaacgaccacggatgatacgactgatcgtaatggtcaacttacatccggtaagggagcattacccaagacaggagagacaactgagcggccagcgtttggcttcttgggtgtcattgtggtcagtctgatgggggtattaggattgaaacggaaacaacgtgaagaatagcctgtccatgcgttgcgtttagggcagcagcgtatcgacaaaaagaaaagggcgctacgatatttggagttgaggttcaaagtcaaatggtactgatgaccggtaaaatttaatattttgaaccttgcttaggcagctgacttcacattgttgagatcagctgccttttgcttatagttcattgagtagaaacggttctgttgcgaagtttgaaaatcaaacgcgcccgctctgaactccaaatatcttaggctgttattcccattaataccttgatttcagtagacaccgaaaagccgaagagcgttccatttcttcggttatttttatatattcctcgaagggtctccatgcccttaatcgtggaagaggctgtacggagactttgataaaatttaatccgtcgtttaataggtcgatggtcttgttctattaaattgttaagatacttcacagttcggtgctctgtcttagtatataaaccca

SEQ ID NO: 323 - protein, 1101 aa, Drosophila melanogaster
  Furin-like protease 1, isoform 1-CRR precursor (Furin-1) S08.048
MKNDVVRWSRQPTSNTTNSSSSSRSDSNSTHKHRSKSNKLNARQLGSNAARSCQQRSSVATTLEDEQQTIIECDIGNFNFDCNLFKTSFLTQHKQKRSGKSSSKSKSNRSRPLAKTKAVFLLALQFSAVVFLCNINVGFVAGSVATAASSAGGSSPAAPSSAPSSPPTVAVPPPPPPSSALKVDPNGQSPVLPPYVLDYETGGKAKLTPNNGKFGQSGSSGSNNNHIVGHYTHTWAVHIPNGDNGMADAVAKDHGFVNLGKIFDDHYHFAHHKVSKRSLSPATHHQTRLDDDDRVHWAKQQRAKSRSKRDFIRMRPSRTSSRAMSMVDAMSFNDSKWPQMWYLNRGGGLDMNVIPAWKMGITGKGVVVTILDDGLESDHPDIQDNYDPKASYDVNSHDDDPMPHYDMTDSNRHGTRCAGEVAATANNSFCAVGIAYGASVGGVRMLDGDVTDAVEARSLSLNPQHIDIYSASWGPDDDGKTVDGPGELASRAFIEGTTKGRGGKGSIFIWASGNGGREQDNCNCDGYTNSIWTLSISSATEEGHVPWYSEKCSSTLATTYSSGGQGEKQVVTTDLHHSCTVSHTGTSASAPLAAGIAALVLQSNQNLTWRDLQHIVVRTAKPANLKDPSWSRNGVGRRVSHSFGYGLMDAAEMVRVARNWKAVPEQQRCEINAPHVDKVIPPRTHITLQLTVNHCRSVNYLEHVQAKITLTSQRRGDIQLFLRSPANTSVTLLTPRIHDNSRSGFNQWPFMSVHTWGESPQGNWQLEIHNEGRYMAQITQWDMIFYGTETPAQPDDVANPSQSNQFNLYGNDMAHNDVEYDSTGQWRNMQQVGEVGMTRDHSNTAACLKWSDRKCLECNDSAYMFEDQCYDVCPVHTYPLDKFQAEEDEQDDEVTRGPVNPYSSSPMDHSLLMSNSLDDKQDPLQAEDRRRRSSLTQLVEVPSRVCAACDRSCLECYGALASQCSTCSPGSQLRKILNETFCYAYVVRSTGMASVVDISKMDDRDTQQYMTGTTVLLLVSVIFTLMGVAVAGGIVYHRRAMARSNELYSRVSLVPGDESDSDEDELFTAHFPARKSGVNIYRDEAPSEKIFEEDEISHLVP

SEQ ID NO: 324 - DNA, 3781 bp, Drosophila melanogaster
  Furin-like protease 1, isoform 1-CRR precursor (Furin-1) S08.048
gacaacaacaaatttaaattgagattttccatattatcaaaagttacaggcgcctattttgcagttatcagtctgaagtcggtgtgaagtgctatcctggacttttcgttttagtcaccccttggcctcatctaacatccacttaattgaaatagaacatttgcatctcagcctcacaaccaatatcccgagcaacgtgcacaaaaactattggaaaaatcctaacccacaatgaaaaacgacgtcgtgcgatggagcaggcagccaactagcaacaccactaacagcagcagcagcagtagaagcgatagcaacagcactcataagcacagaagcaaaagcaacaaattaaatgctcgacaattagggtcaaatgctgccagaagttgtcagcaaagatcctctgtggcaacaacactagaagatgaacaacaaacaatcattgaatgtgatataggaaatttcaatttcgattgcaatttattcaaaactagttttttaacgcaacacaaacagaaacgtagtggcaagagcagcagcaaaagtaagagcaacagaagtagacccctagcgaaaacgaaagcggtgtttctattagctctgcaatttagtgccgtagtttttttatgtaatattaatgtcggtttcgtggccggaagtgtggcaactgcggcatcatcggcaggcggctcatcgccggcagctccatcatctgcgccctcatccccgcccacagttgctgtaccaccgccgccgccaccttcgtcggcactcaaagtggatccaaatggtcagtcaccagtgctgccgccctacgttctcgattatgagacggggggcaaggccaagctaacgccaaacaatggcaagttcggccaatcgggcagttccgggagcaataacaaccacatcgtcggacactatacccacacctgggcggtgcacataccaaacggcgataatggcatggccgatgcggttgccaaggatcacggattcgtcaatttgggcaagatcttcgatgatcactaccacttcgcacatcacaaggtctcgaagcggtcgctctcccccgccacgcatcaccaaactcgcctggatgacgacgatcgcgtccactgggcgaagcagcagcgggccaagtcgcgatccaaacgggactttatccgcatgcgaccctcacggacctcctcgcgagccatgtcgatggtggacgccatgtcctttaacgactccaagtggccgcagatgtggtatctgaatcgtggtggtggcctggacatgaatgtgatacccgcctggaagatgggcataaccggcaagggcgtggtggtgacaattctggatgatggcctggaatccgatcatccggacatacaggataactacgatcccaaagcctcgtacgatgtgaatagccacgacgacgatccgatgccgcattacgatatgacggactcgaaccgccatggaactcgctgtgccggcgaggtggcagccaccgccaacaattcgttctgcgcggtgggtattgcctacggcgccagtgtgggcggagtcaggatgctggacggagacgtcacggatgcggttgaggcacggtcgctgtcgctgaatccgcagcacattgacatatacagtgcctcctggggacccgatgacgatggcaagacggtggacggacccggcgaactggcatcgcgcgcctttatcgagggcacaactaagggacgcggcggcaagggcagcatcttcatatgggcatcgggcaatggtgggcgggagcaggataactgcaactgcgacggctacacgaactccatctggacgctgtccatctccagtgccacggaggagggccatgtgccctggtactcggagaagtgcagctccacgctggccaccacctacagcagcggcgggcagggcgagaagcaggtggtcaccacggacctgcaccactcgtgcactgtctcccacacgggcacctcggcgtcggccccgctcgccgctggcatagccgccctggtgctgcagtccaaccagaatctcacctggcgcgatctgcagcacattgttgtgcgcaccgccaagccggcgaaccttaaggaccccagctggtcacgcaatggggtggggcggcgggtgagccactcctttggctacggattgatggacgccgccgagatggtgcgcgtggcccgcaactggaaggcggtgccggagcagcagcggtgcgagattaacgctccccatgtcgacaaggtcattccacctcgtacccatatcaccctgcaactgacggttaatcactgtcgatcggtcaattacctggagcacgtccaggccaagattacgctaacgtcgcagagacgaggagacattcagctctttttgaggtctcccgcaaacaccagtgtcacgctcctaacgcctaggatacatgacaactctcgttccggattcaatcaatggcccttcatgtctgtgcacacctggggagagtcgccgcaaggaaactggcagctggagatccacaacgagggtcgctatatggcacaaatcacacaatgggatatgatattctacggcaccgaaacgcccgcccaacccgatgacgtggccaatcccagccagtcgaaccagttcaatctgtacggcaacgatatggcccacaatgacgtcgagtacgattccaccggccagtggaggaatatgcagcaggtgggcgaggtgggcatgacccgagatcacagcaacaccgccgcgtgccttaagtggagcgatcgcaagtgcttagagtgcaatgactccgcctatatgttcgaggaccagtgctacgatgtctgcccggtgcacacatatccattggacaagttccaagcagaggaggatgagcaggatgacgaggtgacaaggggtccggttaatccctacagcagctcccccatggatcattccctgttgatgtccaacagcttggatgacaagcaagatcctctgcaggcggaggatcgacgtcgtcgtagttcactcacccaactggtggaggtgccttctcgggtctgtgccgcctgcgatcggagctgcttggagtgctacggtgccctggcctcccagtgcagcacctgctccccgggcagccaactgcgtaagatcctgaacgagaccttctgctatgcctatgtggtgcgtagcacgggaatggccagtgtggtggacatttccaaaatggacgatagagatacccagcaatatatgactggcacaattgtgctccttttggtttcggtgattttcaccctgatgggcgtagcagtggccggtggcatcgtgtatcatcgaagggcaatggctcgatccaacgaactatactcccgagtttccctagtccccggtgacgaaagtgactctgacgaggatgaactgtttacggcccacttcccagcgagaaagagtggtgttaatatatatcgcgatgaagcgcccagcgaaaagatattcgaggaagatgagatcagccacttggtaccctaaataatcaaaacaagttattagttaggtcatgcatttagccatcctcataaccaccagaaatatatctatatgttaagcaaccgacaaacgcatttttggtctatattttgttacattcgacggcattacagctcctttatttcaagccaaaatagattaaagtattaaatgtaaaagaaaaaaaatcaaaactaattatttgtaatatttatgccttaataaaatgattttaactgaaaaaaaa

SEQ ID NO: 325 - protein, 814 aa, Saccharomyces cerevisiae
  Kexin precursor (KEX2 protease)   S08.048
MKVRKYITLCFWWAFSTSALVSSQQIPLKDHTSRQYFAVESNETLSRLEEMHPNWKYEHDVRGLPNHYVFSKELLKLGKRSSLEELQGDNNDHILSVHDLFPRNDLFKRLPVPAPPMDSSLLPVKEAEDKLSINDPLFERQWHLVNPSFPGSDINVLDLWYNNITGAGVVAAIVDDGLDYENEDLKDNFCAEGSWDFNDNTNLPKPRLSDDYHGTRCAGEIAAKKGNNFCGVGVGYNAKISGIRILSGDITTEDEAASLIYGLDVNDIYSCSWGPADDGRHLQGPSDLVKKALVKGVTEGRDSKGAIYVFASGNGGTRGDNCNYDGYTNSIYSITIGAIDHKDLHPPYSEGCSAVMAVTYSSGSGEYIHSSDINGRCSNSHGGTSAAAPLAAGVYTLLLEANPNLTWRDVQYLSILSAVGLEKNADGDWRDSAMGKKYSHRYGFGKIDAHKLIEMSKTWENVNAQTWFYLPTLYVSQSTNSTEETLESVITISEKSLQDANFKRIEHVTVTVDIDTEIRGTTTVDLISPAGIISNLGVVRPRDVSSEGFKDWTFMSVAHWGENGVGDWKIKVKTTENGHRIDFHSWRLKLFGESIDSSKTETFVFGNDKEEVEPAATESTVSQYSASSTSISISATSTSSISIGVETSAIPQTTTASTDPDSDPNTPKKLSSPRQAMHYFLTIFLIGATFLVLYFMFFMKSRRRIRRSRAETYEFDIIDTDSEYDSTLDNGTSGITEPEEVEDFDFDLSDEDHLASLSSSENGDAEHTIDSVLTNENPFSDPIKQKFPNDANAESASNKLQELQPDVPPSSGRS

SEQ ID NO: 326 - DNA, 2848 bp, Saccharomyces cerevisiae
  Kexin precursor (KEX2 protease) S08.048
tgcataattctgtcataagcctgttctttttcctggcttaaacatcccgttttgtaaaagagaaatctattccacatatttcattcattcggctaccatactaaggataaactaatcccgttgttttttggcctcgtcacataattataaactactaacccattatcagatgaaagtgaggaaatatattactttatgcttttggtgggccttttcaacatccgctcttgtatcatcacaacaaattccattgaaggaccatacgtcacgacagtattttgctgtagaaagcaatgaaacattatcccgcttggaggaaatgcatccaaattggaaatatgaacatgatgttcgagggctaccaaaccattatgttttttcaaaagagttgctaaaattgggcaaaagatcatcattagaagagttacagggggataacaacgaccacatattatctgtccatgatttattcccgcgtaacgacctatttaagagactaccggtgcctgctccaccaatggactcaagcttgttaccggtaaaagaagctgaggataaactcagcataaatgatccgctttttgagaggcagtggcacttggtcaatccaagttttcctggcagtgatataaatgttcttgatctgtggtacaataatattacaggcgcaggggtcgtggctgccattgttgatgatggccttgactacgaaaatgaagacttgaaggataatttttgcgctgaaggttcttgggatttcaacgacaataccaatttacctaaaccaagattatctgatgactaccatggtacgagatgtgcaggtgaaatagctgccaaaaaaggtaacaatttttgcggtgtcggggtaggttacaacgctaaaatctcaggcataagaatcttatccggtgatatcactacggaagatgaagctgcgtccttgatttatggtctagacgtaaacgatatatattcatgctcatggggtcccgctgatgacggaagacatttacaaggccctagtgacctggtgaaaaaggctttagtaaaaggtgttactgagggaagagattccaaaggagcgatttacgtttttgccagtggaaatggtggaactcgtggtgataattgcaattacgacggctatactaattccatatattctattactattggggctattgatcacaaagatctacatcctccttattccgaaggttgttccgccgtcatggcagtcacgtattcttcaggttcaggcgaatatattcattcgagtgatatcaacggcagatgcagtaatagccacggtggaacgtctgcggctgctccattagctgccggtgtttacactttgttactagaagccaacccaaacctaacttggagagacgtacagtatttatcaatcttgtctgcggtagggttagaaaagaacgctgacggagattggagagatagcgccatggggaagaaatactctcatcgctatggctttggtaaaatcgatgcccataagttaattgaaatgtccaagacctgggagaatgttaacgcacaaacctggttttacctgccaacattgtatgtttcccagtccacaaactccacggaagagacattagaatccgtcataaccatatcagaaaaaagtcttcaagatgctaacttcaagagaattgagcacgtcacggtaactgtagatattgatacagaaattaggggaactacgactgtcgatttaatatcaccagcggggataatttcaaaccttggcgttgtaagaccaagagatgtttcatcagagggattcaaagactggacattcatgtctgtagcacattggggtgagaacggcgtaggtgattggaaaatcaaggttaagacaacagaaaatggacacaggattgacttccacagttggaggctgaagctctttggggaatccattgattcatctaaaacagaaactttcgtctttggaaacgataaagaggaggttgaaccagctgctacagaaagtaccgtatcacaatattctgccagttcaacttctatttccatcagcgctacttctacatcttctatctcaattggtgtggaaacgtcggccattccccaaacgactactgcgagtaccgatcctgattctgatccaaacactcctaaaaaactttcctctcctaggcaagccatgcattattttttaacaatatttttgattggcgccacatttttggtgttatacttcatgttttttatgaaatcaaggagaaggatcagaaggtcaagagcggaaacgtatgaattcgatatcattgatacagactctgagtacgattctactttggacaatggaacttccggaattactgagcccgaagaggttgaggacttcgattttgatttgtccgatgaagaccatcttgcaagtttgtcttcatcagaaaacggtgatgctgaacatacaattgatagtgtactaacaaacgaaaatccatttagtgaccctataaagcaaaagttcccaaatgacgccaacgcagaatctgcttccaataaattacaagaattacagcctgatgttcctccatcttccggacgatcgtgattcgatatgtacagaaagcttcaaattacaaaatagcatttttttcttatagattataatactctctcatacgtatacgtatatgtgtatatgatatataaacaaacattaatatcctattccttccgtttgaaatccctatgatgtactttgcattgtttgcacccgcgaataaaatgaaaactccgaaccgatatatcaagcacataaaaggggagggtccaattaatgcat

SEQ ID NO: 327 - protein, 794 aa, Homo sapiens
  Furin precursor S08.071
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 328 - DNA, 4180 bp, Homo sapiens
  Furin precursor S08.071
gcggggaagcagcagcggccaggatgaatcccaggtgctctggagctggatggtgaaggtcggcactcttcaccctcccgagccctgcccgtctcggccccatgcccccaccagtcagccccgggccacaggcagtgagcaggcacctgggagccgaggccctatgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 329 - protein, 969 aa, Homo sapiens
  Subtilisin/kexin-like protease PACE4 S08.075
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 330 - DNA, 4403 bp, Homo sapiens
  Subtilisin/kexin-like protease PACE4 S08.075
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatccc

SEQ ID NO: 331 - protein, 662 aa, Anabaena variabilis
  Calcium-dependent protease precursor (Trypsin) S08.79
MVHVRYGGQNGEQYELAISENHIVVRTESRSSLISDRPFEAAPVSPQARNILNQFELSTRFSQAGVEVLHVKEPSHDGALRDTAREILNQEPEVQFAGRVLIDPVSQQPIVYTENLFVKFDHEEDVSFCQEILGRYGLTIKRQLEYARNAYFVSAPSNTGLAIFDISERLLNEESVELCHPELVREFRQRQAFPPQWHLKQTTIGGKTINAHANVEAAWKLSDGTGTIIAIIDDGVDIDHEEFRSSGKIVAPRDVTRKTNFPTPGNRDNHGTACAGVACGNGNFGASGVAPGAKLMPIRFVSALGSQDEADSFVWAAQNGADVISCSWGPPDGTWWDDKDPLHKQKVPLPDSTRLAMDYAINKGRNGKGCVILFAAGNGNESVDNDGYASYEKVIAVAACNDFGTRSAYSDFGTAVWCAFPSNNGNPSQTPGIWTADRTGVVGYNSGNTNLGDQAGNYTNSFGGTSSACPGAAGVAALILSRNPNLRWDEVRDIIKRSCDRIDPVGGNYNAEGRSPFYGYGRINALKAVELALPAQPEPVSIFTAVQDVPINDLQISQLSLAIANTNPIKSIKVTVDIEHTYIGDLVVSLNPPAESGVLPIILHDRKGGGADDIKQTYDEVSTPGLTALKGKIPQGTWTLEVADKAQADTGKIRSLTIELGF

SEQ ID NO: 332 - DNA, 2187 bp, Anabaena variabilis
  Calcium-dependent protease precursor (Trypsin) S08.79
ggtaggctgttgattttgtgccttttcagggttgaaaaatttatgcactatcctgttctagctgagtaaaatttgcagtgggaaaagttcattacccattacccattacccatttctggaaagccagactgatagtttgtatccacaggaaattgttctaagctgcgtcttatgtgtgcgtcattttggaaacagcacacaaaatacagaggcttagtatcaacttaatagtaggagattaagtatggttcatgtccgctatggtggtcagaacggtgaacagtacgaattagcgattagtgagaatcatattgtagtacggactgaaagccgcagctcgctaattagcgatcgcccctttgaagccgcccctgtttcaccccaagcccgtaatatcctcaatcaattcgagttatcaactcgtttcagccaagcaggtgtagaagttctccatgtgaaggaaccaagccacgatggtgctttgcgcgacacagccagggaaattctcaatcaagaacctgaggtgcaatttgccggacgtgtgttaattgatccggtcagtcaacaacccatagtttacacagaaaacctcttcgtgaagtttgaccacgaagaagacgttagtttctgccaagaaattttgggacgctacggcttaacaattaaacgtcaactagaatacgcccgtaatgcctactttgtcagcgcaccctccaatactggtttagccatctttgatatttccgaaaggttgctcaacgaggaatcggtggaattgtgtcatcctgaattggtgcgggaatttagacaacgtcaggcatttcccccgcaatggcatctcaagcaaaccacgattgggggtaaaactatcaatgcccacgccaatgttgaggcggcatggaagttgagcgatggtacgggaacgattattgccattattgatgatggtgtggatatcgaccatgaagagttccgttcctctggtaagattgtcgcccctagagatgtcacacggaaaaccaactttcccacaccaggaaaccgagataatcacggtacggcttgtgcaggtgtagcttgtggtaatggcaactttggggcttctggggtagcgcctggggctaagttaatgcccattcgtttcgtttctgccctgggttcccaagatgaagccgactcttttgtctgggctgctcaaaatggtgcggatgtaatttcctgtagttgggggccaccagatggtacatggtgggatgataaagaccccctacacaagcagaaagtacctctacccgattccacaagactagcaatggactatgccatcaataaggggcgtaatggcaaaggatgtgtgattttattcgctgcgggtaatggtaacgaaagcgtagataatgacggctacgccagctatgaaaaggtcatagctgtcgcggcttgtaacgactttggtactaggagtgcttacagtgattttggtacagccgtctggtgtgcctttcctagcaacaacggtaacccttcccaaacccctggtatttggacagccgatcgcactggtgtagtcggttataattccggtaatactaatctcggtgaccaggcaggcaattatacaaatagtttcggtggcacctctagcgcctgtcctggtgcagctggtgtcgccgccttgattctctctcgcaatccaaatctgcgttgggatgaggtcagagatattattaaacgctcatgcgatcgcattgatccagttggtggtaactataacgctgaaggtcgtagcccattctacggttatggtcgtatcaatgccctcaaagcggtagaattggcactacccgcacaacctgagccagtcagcattttcacggctgtgcaggatgtccccatcaacgacttgcagatatctcaactcagtttagcgatcgctaacaccaaccccatcaaatctatcaaagttacggtagatatcgagcatacctacatcggtgacttagtagttagcctcaacccccctgctgaatccggtgtattaccaatcatcctccacgaccgcaaaggcgaggcgcagatgatatcaaacaaacttacgatgaggtgagtacaccaggactaactgctttgaagggtaaaattcctcaaggaacctggactttagaagtagcagataaagcacaggcg

SEQ ID NO: 333 - protein, 402 aa, Rattus norvegicus
  Caspase-1 precursor  C14.001
MADKVLRAKRKQFINSVSVGTINGLLDELLEKRVLNQEEMDTIKLANITVMEKARDLCDHVTKKGPRASQMFITYICNEDCYLAEILELQSGPSAETVFVTEDSKGGHPFSSETKEKLNKEGGAFPGPSGSLKFCPLEIAQKLWKENHSEIYPIMKTPTRTRLALIICNTDFQHLSRRVGADVDLREMKLLLQDLGYTVKVKENLTALEMTKELKEFAACPEHKTSDSTFLVFMSHGLQEGICGITYSNEVADILKVDTIFQMMNTLKCPSLKDKPKVIIIQACRGEKQGVVLLKDSVGNSEEGFLTDAIFEDDGIKKAHIEKDFIAFCSSTPDNVSWRHPVRGSLFIESLIKHMKEYAWSCDLEDIFRKVRFSFEQPDSRLQMPTTERVTLTKRFYLFPGH

SEQ ID NO: 334 - DNA, 1209 bp, Rattus norvegicus
  Caspase-1 precursor C14.001
atggccgacaaggtcctgagggcaaagaggaagcaatttatcaactcagtgagtgtagggacaataaatggattgctggatgaacttttagagaagagagtcctgaaccaggaagagatggatacaatcaaacttgcaaatatcactgttatggaaaaggcacgagacctgtgcgatcatgtcactaaaaaaggaccccgggcaagccagatgtttatcacttacatttgtaatgaagactgctacctggcagaaattctggagcttcagtcaggtccatcagctgaaactgtttttgttacagaagattctaagggaggacatcctttctcctcagaaacaaaagaaaaactgaacaaagaaggtggcgcatttcctggaccgagtggttccctcaagttttgccctttagaaatagcccagaaattatggaaagaaaatcattcagagatttatccaataatgaaaacacccactcgtacacgtcttgccctcattatctgcaacacagactttcaacatctttctcggagagtcggagctgatgttgacctcagagaaatgaagttgctgctgcaggatctgggctatactgtgaaagtcaaagaaaatctcacagctctggagatgacaaaagaattgaaagaatttgctgcctgcccagagcacaagacttctgacagtaccttccttgtattcatgtctcatggtctccaggagggaatatgtgggatcacatactctaatgaagttgcagatattttaaaggttgacacaatctttcaaatgatgaacacattgaagtgcccaagcttgaaagacaagcccaaggttatcattattcaggcatgccgtggagagaaacaaggagtggtgttgttaaaagattcagtaggaaactccgaagagggattcttaacagatgcaatttttgaagatgatggcattaagaaggcccatatagagaaagattttattgctttctgctcttcaacaccagataatgtgtcctggagacatcctgtccggggatccctcttcattgagtcactcatcaaacacatgaaagaatatgcctggtcttgtgacttggaggacattttcagaaaggttcgattttctttcgaacaaccagactctagactacagatgccaaccactgaaagggtgaccctgacaaaacgtttctacctcttcccaggacattag

SEQ ID NO: 335 - protein, 503 aa, Caenorhabditis elegans
  Cell death protein 3 precursor   C14.002
MMRQDRRSLLERNIMMFSSHLKVDEILEVLIAKQVLNSDNGDMINSCGTVREKRREIVKAVQRRGDVAFDAFYDALRSTGHEGLAEVLEPLARSVDSNAVEFECPMSPASHRRSRALSPAGYTSPTRVHRDSVSSVSSFTSYQDIYSRARSRSRSRALHSSDRHNYSSPPVNAFPSQPSSANSSFTGCSSLGYSSSRNRSFSKASGPTQYIFHEEDMNFVDAPTISRVFDEKTMYRNFSSPRGMCLIINNEHFEQMPTRNGTKADKDNLTNLFRCMGYTVICKDNLTGRGMLLTIRDFAKHESHGDSAILVILSHGEENVIIGVDDIPISTHEIYDLLNAANAPRLANKPKIVFVQACRGERRDNGFPVLDSVDGVPAFLRRGWDNRDGPLFNFLGCVRPQVQQVWRKKPSQADILIAYATTAQYVSWRNSARGSWFIQAVCEVFSTHAKDMDVVELLTEVNKKVACGFQTSQGSNILKQMPEMTSRLLKKFYFWPEARNSAV

SEQ ID NO: 336 - DNA, 7653 bp, Caenorhabditis elegans
  Cell death protein 3 precursor C14.002
agatctgaaataaggtgataaattaataaattaagtgtatttctgaggaaatttgactgttttagcacaattaatcttgtttcagaaaaaaagtccagttttctagatttttccgtcttattgtcgaattaatatccctattatcactttttcatgctcatcctcgagcggcacgtcctcaaagaattgtgagagcaaacgcgctcccattgacctccacactcagccgccaaaacaaacgttcgaacattcgtgtgttgtgctccttttccgttatcttgcagtcatcttttgtcgtttttttctttgttctttttgttgaacgtgttgctaagcaattattacatcaattgaagaaaaggctcgccgatttattgttgccagaaagattctgagattctcgaagtcgattttataatatttaaccttggtttttgcattgtttcgtttaaaaaaaccactgtttatgtgaaaaacgattagtttactaataaaactacttttaaacctttacctttacctcaccgctccgtgttcatggctcatagattttcgatactcaaatccaaaaataaatttacgagggcaattaatgtgaaacaaaaacaatcctaagatttccacatgtttgacctctccggcaccttcttccttagccccaccactccatcacctctttggcggtgttcttcgaaacccacttaggaaagcagtgtgtatctcatttggtatgctcttttcgattttatagctctttgtcgcaatttcaatgctttaaacaatccaaatcgcattatatttgtgcatggaggcaaatgacggggttggaatcttagatgagatcaggagctttcagggtaaacgcccggttcattttgtaccacatttcatcattttcctgtcgtccttggtatcctcaacttgtcccggttttgttttcggtacactcttccgtgatgccacctgtctccgtctcaattatcgtttagaaatgtgaactgtccagatgggtgactcatattgctgctgctacaatccactttcttttctcatcggcagtcttacgagcccatcataaacttttttttccgcgaaatttgcaataaaccggccaaaaactttctccaaattgttacgcaatatatacaatccataagaatatcttctcaatgtttatgatttcttcgcagcactttctcttcgtgtgctaacatcttatttttataatatttccgctaaaattccgatttttgagtattaatttatcgtaaaattatcataatagcaccgaaaactactaaaaatggtaaaagctccttttaaatcggctcgacattatcgtattaaggaatcacaaaattctgagaatgcgtactgcgcaacatatttgacggcaaaatatctcgtagcgaaaactacagtaattctttaaatgactactgtagcgcttgtgtcgatttacgggctcaatttttgaaaataattttttttttcgaattttgataacccgtaaatcgtcacaacgctacagtagtcatttaaaggattactgtagttctagctacgagatattttgcgcgccaaatatgactgtaatacgcattctctgaattttgtgtttccgtaataatttcacaagattttggcattccactttaaaggcgcacaggatttattccaatgggtctcggcacgcaaaaagtttgatagacttttaaattctccttgcatttttaattcaattactaaaattttcgtgaatttttctgttaaaatttttaaaatcagttttctaatattttccaggctgacaaacagaaacaaaaacacaacaaacattttaaaaatcagttttcaaattaaaaataacgatttctcattgaaaattgtgttttatgtttgcgaaaataaaagagaactgattcaaaacaattttaacaaaaaaaaaccccaaaattcgccagaaatcaagataaaaaattcaagagggtcaaaattttccgattttactgactttcaccttttttttcgtagttcagtgcagttgttggagtttttgacgaaaactaggaaaaaaatcgataaaaattactcaaatcgagctgaattttgaggacaatgtttaaaaaaaaacactatttttccaataatttcactcattttcagactaaatcgaaaatcaaatcgtactctgactacgggtcagtagagaggtcaaccatcagccgaagatgatgcgtcaagatagaaggagcttgctagagaggaacattatgatgttctctagtcatctaaaagtcgatgaaattctcgaagttctcatcgcaaaacaagtgttgaatagtgataatggagatatgattaatgtgagtttttaatcgaataataattttaaaaaaaaattgataatataaagaatatttttgcagtcatgtggaacggttcgcgagaagagacgggagatcgtgaaagcagtgcaacgacggggagatgtggcgttcgacgcgttttatgatgctcttcgctctacgggacacgaaggacttgctgaagttcttgaacctctcgccagatcgtaggtttttaaagttcggcgcaaaagcaagggtctcacggaaaaaagaggcggatcgtaattttgcaacccaccggcacggttttttcctccgaaaatcggaaattatgcactttcccaaatatttgaagtgaaatatattttatttactgaaagctcgagtgattatttattttttaacactaattttcgtggcgcaaaaggccattttgtagatttgccgaaaatacttgtcacacacacacacacacatctccttcaaatatccctttttccagtgttgactcgaatgctgtcgaattcgagtgtccaatgtcaccggcaagccatcgtcggagccgcgcattgagccccgccggctacacttcaccgacccgagttcaccgtgacagcgtctcttcagtgtcatcattcacttcttatcaggatatctactcaagagcaagatctcgttctcgatcgcgtgcacttcattcatcggatcgacacaattattcatctcctccagtcaacgcatttcccagccaaccttgtatgttgatgcgaacactaaattctgagaatgcgcattactcaacatatttgacgcgcaaatatctcgtagcgaaaaatacagtaaccctttaaatgactattgtagtgtcgatttacgggctcgattttcgaaacgaatatatgctcgaattgtgacaacgaattttaatttgtcatttttgtgttttcttttgatatttttgatcaattaataaattatttccgtaaacagacaccagcgctacagtactcttttaaagagttacagtagttttcgcttcaagatattttgaaaagaattttaaacattttgaaaaaaaatcatctaacatgtgccaaaacgcttttttcaagtttcgcagattttttgatttttttcattcaagatatgcttattaacacatataattatcattaatgtgaatttcttgtagaaattttgggcttttcgttctagtatgctctacttttgaaattgctcaacgaaaaaatcatgtggtttgttcatatgaatgacgaaaaatagcaattttttatatattttcccctattcatgttgtgcagaaaaatagtaaaaaagcgcatgcatttttcgacattttttacatcgaacgacagctcacttcacatgctgaagacgagagacgcggagaaataccacacatctttctgcgtctctcgtcttcagcatgtgaaatgggatctcggtcgatgtaaaaaaatgtcgaataatgtaaaaaatgcatgcgtttttttacacttttctgcacaaatgaatagggggaaaatgtattaaaatacattttttgtatttttcaacatcacatgattaaccccattattttttcgttgagcaacttaaaaagtagagaatattagagcgaaaaccaaaatttcttcaagatattacctttattgataattatagatgttaataagcatatcttgaatgaaagtcagcaaaaatatgtgcgaaacacctgaaaaaaatcaaaaattctgcgaaaattgaaaaaatgcattaaaatacatttttgcatttttctacatcacatgaatgtagaaaattaaaagggaaatcaaaatttctagaggatataattgaatgaaacattgcgaaattaaaatgtgcgaaacgtcaaaaaagaggaaatttgggtatcaaaatcgatcctaaaaccaacacatttcagcatccgccaactcttcattcaccggatgctcttctctcggatacagttcaagtcgtaatcgctcattcagcaaagcttctggaccaactcaatacatattccatgaagaggatatgaactttgtcgatgcaccaaccataagccgtgttttcgacgagaaaaccatgtacagaaacttctcgagtcctcgtggaatgtgcctcatcataaataatgaacactttgagcagatgccaacacggaatggtaccaaggccgacaaggacaatcttaccaatttgttcagatgcatgggctatacggttatttgcaaggacaatctgacgggaagggtacggcgaaattatattacccaaacgcgaaatttgccattttgcgccgaaaatgtggcgcccggtctcgacacgacaatttgtgttaaatgcaaaaatgtataattttgcaaaaaacaaaattttgaacttccgcgaaaatgatttacctagtttcgaaattttcgttttttccggctacattatgtgttttttcttagtttttctataatatttgatgtaaaaaaccgtttgtaaattttcagacaattttccgcatacaaaacttgatagcacgaaatcaattttctgaattttcaaaattatccaaaaatgcacaatttaaaatttgtgaaaattggcaaacggtgtttcaatatgaaatgtatttttaaaaactttaaaaaccactccggaaaagcaataaaaatcaaaacaacgtcacaattcaaattcaaaagttattcatccgatttgtttatttttgcaaaatttgaaaaaatcatgaaggatttagaaaagttttataacattttttctagatttttcaaaattttttttaacaaatcgagaaaaagagaatgaaaaatcgattttaaaaatatccacagcttcgagagtttgaaattacagtactccttaaaggcgcacaccccatttgcattggaccaaaaatttgtcgtgtcgagaccaggtaccgtagtttttgtcgcaaaaattgcaccattggacaataaaccttcctaatcaccaaaaagtaaaattgaaatcttcgaaaagccaaaaaattcaaaaaaaaagtcgaatttcgattttttttttggttttttggtcccaaaaaccaaaaaaatcaattttctgcaaaataccaaaaagaaacccgaaaaaatttcccagccttgttcctaatgtaaactgatatttaatttccagggaatgctcctgacaattcgagactttgccaaacacgaatcacacggagattctgcgatactcgtgattctatcacacggagaagagaatgtgattattggagttgatgatataccgattagtacacacgagatatatgatcttctcaacgcggcaaatgctccccgtctggcgaataagccgaaaatcgtttttgtgcaggcttgtcgaggcggttcgttttttattttaattttaatataaatattttaaataaattcattttcagaacgtcgtgacaatggattcccagtcttggattctgtcgacggagttcctgcatttcttcgtcgtggatgggacaatcgagacgggccattgttcaattttcttggatgtgtgcggccgcaagttcaggttgcaatttaatttcttgaatgagaatattccttcaaaaaatctaaaatagatttttattccagaaagtcccgatcgaaaaattgcgatataattacgaaatttgtgataaaatgacaaaccaatcagcatcgtcgatctccgcccacttcatcggattggtttgaaagtgggcggagtgaattgctgattggtcgcagttttcagtttagagggaatttaaaaatcgccttttcgaaaattaaaaattgattttttcaattttttcgaaaaatattccgattattttatattctttggagcgaaagccccgtcctgtaaacatttttaaatgataattaataaatttttgcagcaagtgtggagaaagaagccgagccaagctgacattctgattgcatacgcaacgacagctcaatatgtttcgtggagaaacagtgctcgtggatcatggttcattcaagccgtctgtgaagtgttctcgacacacgcaaaggatatggatgttgttgagctgctgactgaagtcaataagaaggtcgcttgtggatttcagacatcacagggatcgaatattttgaaacagatgccagaggtacttgaaacaaacaatgcatgtctaacttttaaggacacagaaaaataggcagaggctccttttgcaagcctgccgcgcgtcaacctagaattttagtttttagctaaaatgattgattttgaatattttatgctaatttttttgcgttaaattttgaaatagtcactatttatcgggtttccagtaaaaaatgtttattagccattggattttactgaaaacgaaaatttgtagtttttcaacgaaatttatcgatttttaaatgtaaaaaaaaatagcgaaaattacatcaaccatcaagcatttaagccaaaattgttaactcatttaaaaattaattcaaagttgtccacgagtattacacggttggcgcgcggcaagtttgcaaaacgacgctccgcctctttttctgtgcggcttgaaaacaagggatcggtttagatttttccccaaaatttaaattaaatttcagatgacatcccgcctgctcaaaaagttctacttttggccggaagcacgaaactctgccgtctaaaattcactcgtgattcattgcccaattgataattgtctgtatcttctcccccagttctctttcgcccaattagtttaaaaccatgtgtatattgttatcctatactcatttcactttatcattctatcatttctcttcccattttcacacatttccatttctctacgataatctaaaattatgacgtttgtgtctcgaacgcataataattttaataactcgttttgaatttgattagttgttgtgcccagtatatatgtatgtactatgcttctatcaacaaaatagtttcatagatcatcaccccaaccccaccaacctaccgtaccatattcatttttgccgggaatcaatttcgattaattttaacctattttttcgccacaaaaaatctaatatttgaattaacgaatagcattcccatctctcccgtgccggaatgcctcccggccttttaaagttcggaacatttggcaattatgtataaatttgtaggtcccccccatcatttcccgcccatcatctcaaattgcattcttttttcgccgtgatatcccgattctggtcagcaaagatct

SEQ ID NO: 337 - protein, 277 aa, Homo sapiens
  Caspase-3 precursor C14.003
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 338 - DNA, 2635 bp, Homo sapiens
  Caspase-3 precursor C14.003
gaattcggcacgaggggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggatgccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcattttagaccatttatctgggattatggttttgtgatgtttgtcctgaacacttttgttgtaaaaaaataataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacacagcatgtaatggtatcttaaagtgtgtttctatgtgacaattttgtacaaatttgttattttccatttttatttcaaaatatacattcaaacttaaaatt

SEQ ID NO: 339 - protein, 303 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 340 - DNA, 912 bp, Homo sapiens
  Caspase-7 precursor C14.004
atggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatgccatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatag

SEQ ID NO: 341 - protein, 293 aa, Homo sapiens
  Caspase-6 precursor C14.005
MSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 342 - DNA, 1545 bp, Homo sapiens
  Caspase-6 precursor C14.005
ccgagggcggggccgggcccgggagcctgtggcttcaggaagaggagggcaaggtgtctggctgcgcgtttggctgcaatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggcgcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcatccaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaatttcacactctgtattgaaaatggctttctcagccaggcgtggttactcacacctgtaatcccagcactttgggagtccaaggtgggcggatcacctgaggtcgggagttcgagaccagcctgaccaacatggcagaagccccgcctctactaaaaatgcaaaaaaaaatttagctaggcatggcggcgcatgcctgcaatcccagctacttggaaggctgaggcaggagaatcacttgaacccaggaggtggaggctgcggtgagccgagcattgcgccattgcactccagcctgggcaacgagtgaaactccgtctcaaaaaaaaagaaaatgtctttctcttccttttatataaatatcgttagggtgaagcattatggtctaatgattcaaatgttttaaagtttaatgcctagcagagaactgccttaaaaaaaaaaagttcatgttggccatggtgaaagggtttgatatggagaaacaaaatcctcaggaaattagataaataaaaatttataagcatttgtattattttttaataaactgcagggttacacaaaaatct

SEQ ID NO: 343 - protein, 452 aa, Mus musculus
  Caspase-2 precursor  C14.006
MAAPSGRSQSSLHRKGLMAADRRSRILAVCGMHPDHQETLKKNRVVLAKQLLLSELLEHLLEKDIITLEMRELIQAKGGSFSQNVELLNLLPKRGPQAFDAFCEALRETRQGHLEDLLLTTLSDIQHVLPPLSCDYDTSLPFSVCESCPPHKQLRLSTDATEHSLDNGDGPPCLLVKPCTPEFYQAHYQLAYRLQSQPRGLALVLSNVHFTGEKDLEFRSGGDVDHTTLVTLFKLLGYNVHVLHDQTAQEMQEKLQNFAQLPAHRVTDSCVVALLSHGVEGGIYGVDGKLLQLQEVFRLFDNANCPSLQNKPKMFFIQACRGDETDRGVDQQDGKNHTQSPGCEESDAGKEELMKMRLPTRSDMICGYACLKGNAAMRNTKRGSWYIEALTQVFSERACDMHVADMLVKVNALIKEREGYAPGTEFHRCKEMSEYCSTLCQQLYLFPGYPPT

SEQ ID NO: 344 - DNA, 3395 bp, Mus musculus
  Caspase-2 precursor C14.006
ctggaaatggcggcgccgagcgggaggtcgcagtcctccctgcacaggaaggggctgatggcggctgacaggaggagcaggattttggcagtgtgtggaatgcatcctgaccaccaggaaacactgaaaaagaatcgagtggtgctggccaagcagctgctgctgagcgagctgttagaacacctcctagagaaggacattatcactttggaaatgagggagctcatccaggccaaagggggcagtttcagccagaatgtggaactcctcaacctgctgccaaagagaggaccccaggcttttgatgccttctgtgaagccctgcgggagaccaggcagggtcacttggaagacttactgctcacaaccctctcagatattcagcacgtactcccaccgttgagctgtgactatgacacaagtctccctttctcggtgtgtgagtcctgccctcctcacaagcagctccgcctatccacagatgctacggaacactccttagataatggtgatggtcctccctgtcttctggtgaagccatgcactcctgagttttaccaggcacactaccagctggcctataggttgcaatctcagccccgtggcttggcactggtgctgagcaatgtgcacttcactggagagaaagacctggaattccgctctggaggggatgtggaccacactactctagtcaccctcttcaagcttttgggctacaatgtccatgtgctacatgaccagaccgcacaggaaatgcaagagaaacttcagaattttgcacagttacctgcacaccgggtcacagactcctgcgtagtggcactcctctcacatggtgtggaaggtggcatctatggtgtagatggcaaactgcttcagctccaagaggtttttcgactttttgacaatgctaactgtccaagtctacagaacaagccaaaaatgttcttcatccaagcatgtcgtggagatgagacagatagaggtgtcgaccagcaagatggaaagaaccacacacaatcccctggatgtgaggagagtgatgctggcaaagaggagttgatgaagatgagactgcctactcgctcagacatgatatgtggctatgcttgccttaaaggtaatgctgccatgcggaacaccaaacggggttcctggtacattgaggccctcactcaggtgttctctgaaagagcttgtgacatgcacgtggccgacatgcttgttaaggtgaatgcccttatcaaggagcgtgaaggctatgcccctggcacagaattccaccgatgcaaggagatgtctgagtactgtagtactctgtgccagcaactctacctgttcccaggctacccacccacgtgatgccgcctgctattcctgctgttggaggccactggaccactgggggcacaatggagacttctcttcagaatggtttttgttctgtctaccctctcagggatatgagattctcccaggcttgtttcctgtcagccatctctgtctttgggtatgaaacataaggatggctcctccggtgtcgtgttctctacctatagagccagctctgaatggatgtgttaccagaagcattttagctacagcctagaaaatgacattgtgaacacagtattattgtgggaagagggcatttggatttctcaatgtttgtgatatttttgttcccaaggcatcttaggagtacttggatcatagctttttttttttttcctaaatcagttaaggagtctcagagatcatctccttttttttccatatctacaacctcatttttcccacagtggagatttggaagatgtcccaatttaatgtaggtgttttcatctgtcatgaagggacagatgagatcctactacttgcgaagtttctatgcatacctttaagttcaggccctaggtgaaggacagtccctcagcctttccattggttcctttgtgttcagtgcacccagcctttgaacagagcctagggtctgtatgccatgacactggaagtcatagaaatttccctggtcatgctttgtttgaactgtcactgaatgaaccttatcgggcataactacatgaaaatgcagtgacagctgagtgtgctgtgtctcacactatcacccgtcatcaggatgtctctccttccttactgtggcttctgcatgcacttacactgtacttgacggctggcctccagggtctctcttgctttgtactggttcccctctttaccttcaccattcgctgcttctgccaagtctgtgaagccgtcctttgtaggatgtttcttgccacttacgctgtactgtagttgcttattctttctgccttctgcttcagcgtgaggcttctttggttttctgtggcagcgtctcccttctcattgtttctctgtgttttagtggggatagtaccatatgtgatataacctagaagcacttgtctctgctcttatgaaacttgcttattcttgaaaaccttctgcatttccattttttcctctcttccaatttattctccatgtaacagagtagtttggtttttaaaatatctggtgatgtcattctcttgcttagaacactagcttcctgttacgcttcatctaaaatgcaaattcttacacccagcttacgagatctggctcataccttccctttggatctcattaaatggtgatttctcactatgctccagcccctcttaggtcctcatctccgtcttgcaggtgttctgaactctcctttggctagtctctgatttttgagtctggcggaggcctcttgaccatgctgcccatgctgtctactgtgcctccttatgagggcatcatgttggtctctgttgtgcttactgcaggctgtaatggcacttttgcttgtttcacttgttccctctgaggctgaatgctccaagagagtgggaactgtgcttcttacttactgatatccagtaactggcacttactaggtcttcatgaatgtttcctgagtaaaggaaggagaccagcagctaaccttagttagagcctaccttttgcagtttctaaattgctattatagtgtacagttcaattagtatatgggtttttttttccaggtgttttatttttatccactgttttgttgttgtttttttatattttctacatatcacgtgtgagacaacttctttcacatctccatagtgcccagcaaatttgaggcctatggtagttgaggtgctcaactaatgtttgttgtatgaaccaagtggtttgaagacttgctgccaaattctgccttttgggtcagtataggatgcataagtggtagaatcttcacacttcccactgccaagattttgtattgccatcaggtgccaaataaatgttgatacttattactg

SEQ ID NO: 345 - protein, 377 aa, Homo sapiens
  Caspase-4 precursor  C14.007
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 346 - DNA, 1291 bp, Homo sapiens
  Caspase-4 precursor C14.007
gctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaaaaaaaaa

SEQ ID NO: 347 - protein, 418 aa, Homo sapiens
  Caspase-5 precursor C14.008
MFKGILQSGLDNFVINHMLKNNVAGQTSIQTLVPNTDQKSTSVKKDNHKKKTVKMLEYLGKDVLHGVFNYLAKHDVLTLKEEEKKKYYDAKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLAVISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 348 - DNA, 1400 bp, Homo sapiens
  Caspase-5 precursor C14.008
cggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgatgccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcagtcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgta

SEQ ID NO: 349 - protein, 479 aa, Homo sapiens
  Caspase-8 precursor C14.009
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 350 - DNA, 2887 bp, Homo sapiens
  Caspase-8 precursor C14.009
gattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtagaagaaacttcttcctgggagcctttcccacccccttccctgctgagcacgtggagttaggcaggttaggggactcggagactgcgatggtgccaggaaagggtggagcggattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaaaggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttacgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggatttgcttgaacccaagaggtccaaggctgcagtgagccatgttcacaccgctgcactcaagcttgggtgacagagcaagaccccgtccccaaaaaaattttttttttaataaacccaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttccaaaacattttttaatagaataaaatataatttgatcttaaaaaaaaaaaaaaaaaaaaaaaaaaaaaaaaaaaaaaaa

SEQ ID NO: 351 - protein, 416 aa, Homo sapiens
  Caspase-9 precursor C14.010
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 352 - DNA, 1481 bp, Homo sapiens
  Caspase-9 precursor C14.010
gccatggacgaagcggatcggcggctcctgcggcggtgccggctgcggctggtggaagagctgcaggtggaccagctctgggacgtcctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcaggaaagttgtcgaagccaaccctagaaaaccttaccccagtggtgctcagaccagagattcgcaaaccagaggttctcagaccggaaacacccagaccagtggacattggttctggaggattcggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcggcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcacccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtgg

SEQ ID NO: 353 - protein, 521 aa, Homo sapiens
  Caspase-10 precursor   C14.011
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRMLKFLEKTMEIRGRKRTVWGAKQISATSLPTAISAQTPRPPMRRWSSVS

SEQ ID NO: 354 - DNA, 3536 bp, Homo sapiens
  Caspase-10 precursor C14.011
tgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcaatatagcagagagtttttgttggttcttagacctcaaacgaatcattgggtataacctccagcctcctgcccagcacaggaatcggtggtctccacctgtcattctagaaacaggaaacaccgtgttttctgacacagtcaattctgattttctttttcttttgcaagtctaaatgttagaaaactttctttttttggagatagtctcattctgtcacccagactggagtgcaggggggcaatcacggctcactgtagtctcgacctcccaggctcaagctgtcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaat

SEQ ID NO: 355 - protein, 373 aa, Mus musculus
  Caspase-11  C14.012
MAENKHPDKPLKVLEQLGKEVLTEYLEKLVQSNVLKLKEEDKQKFNNAERSDKRWVFVDAMKKKHSKVGEMLLQTFFSVDPGSHHGEANLEMEEPEESLNTLKLCSPEEFTRLCREKTQEIYPIKEANGRTRKALIICNTEFKHLSLRYGAKFDIIGMKGLLEDLGYDVVVKEELTAEGMESEMKDFAALSEHQTSDSTFLVLMSHGTLHGICGTMHSEKTPDVLQYDTIYQIFNNCHCPGLRDKPKVIIVQACRGGNSGEMWIRESSKPQLCRGVDLPRNMEADAVKLSHVEKDFIAFYSTTPHHLSYRDKTGGSYFITRLISCFRKHACSCHLFDIFLKVQQSFEKASIHSQMPTIDRATLTRYFYLFPGN

SEQ ID NO: 356 - DNA, 1350 bp, Mus musculus
  Caspase-11 C14.012
tcttcacagtgcgaaagaactgaggctttttctcatggctgaaaacaaacaccctgacaaaccacttaaggtgttggaacagctgggcaaagaagtccttacggagtacctagaaaaattagtacaaagcaatgtactgaaattaaaggaggaagataaacaaaaatttaacaatgctgaacgcagtgacaagcgttgggtttttgtagatgccatgaaaaagaaacacagcaaagtaggtgaaatgcttctccagacattcttcagtgtggacccaggcagccaccatggtgaagctaatctggaaatggaggaaccagaagaatcattgaacactctcaagctttgttcccctgaagagttcacaaggctttgcagagaaaagacacaagaaatttacccaataaaggaggccaatggccgtacacgaaaggctcttatcatatgcaatacagagttcaaacatctctcactgaggtatggggctaaatttgacatcattggtatgaaaggccttcttgaagacttaggctacgatgtggtggtgaaagaggagcttacagcagagggcatggagtcagagatgaaagactttgctgcactctcagaacaccagacatcagacagcacattcctggtgctaatgtctcatggcacactgcatggcatttgtggaacaatgcacagtgaaaaaactccagatgtgctacagtatgataccatctatcagatattcaacaattgccactgtccaggtctacgagacaaacccaaagtcatcattgtgcaggcctgcagaggtgggaactctggagaaatgtggatcagagagtcttcaaaaccccagttgtgcagaggtgtagatctacctaggaatatggaagctgatgctgtcaagctgagccacgtggagaaggacttcattgccttctactctacaaccccacatcacttgtcctaccgagacaaaacaggaggctcttacttcatcactagactcatttcctgcttccggaaacatgcttgctcttgtcatctctttgatatattcctgaaggtgcaacaatcatttgaaaaggcaagtattcattcccagatgcccaccattgatcgggcaaccttgacaagatatttctacctctttcctggcaactgagaacaaagcaacaagcaactgaatctcatttcttcagcttgaagaagtgatcttggccaaggatcacattctattcctgaaattccagaactagtgaaattaaggaaagaatacttatgaattcaagaccagcctaagcaacacagtgggattctgttccatagacaagcaaacaagcaaaaataaaaaaaaaa

SEQ ID NO: 357 - protein, 419 aa, Mus musculus
  Caspase-12 precursor C14.013
MAARRTHERDPIYKIKGLAKDMLDGVFDDLVEKNVLNGDELLKIGESASFILNKAENLVENFLEKTDMAGKIFAGHIANSQEQLSLQFSNDEDDGPQKICTPSSPSESKRKVEDDEMEVNAGLAHESHLMLTAPHGLQSSEVQDTLKLCPRDQFCKIKTERAKEIYPVMEKEGRTRLALIICNKKFDYLFDRDNADTDILNMQELLENLGYSVVLKENLTAQEMETELMQFAGRPEHQSSDSTFLVFMSHGILEGICGVKHRNKKPDVLHDDTIFKIFNNSNCRSLRNKPKILIMQACRGRYNGTIWVSTNKGIATADTDEERVLSCKWNNSITKAHVETDFIAFKSSTPHNISWKVGKTGSLFISKLIDCFKKYCWCYHLEEIFRKVQHSFEVPGELTQMPTIERVSMTRYFYLFPGN

SEQ ID NO: 358 - DNA, 2228 bp, Mus musculus
  Caspase-12 precursor C14.013
ggcacgagcggcacgagcggcacgagcacagccatggcggccaggaggacacatgaaagagatccaatctacaagatcaaaggtttggccaaggacatgctggatggggtttttgatgacctggtggagaagaatgttttaaatggagatgagttactcaaaataggggaaagtgcgagtttcatcctgaacaaggctgagaatctggttgagaacttcttagagaaaacagacatggcaggaaaaatatttgctggccacattgccaattcccaggaacagctgagtttacaattttctaatgatgaggatgatggacctcagaagatatgtacaccttcttctccatcagaatccaagagaaaagtagaggatgatgaaatggaggtaaatgctggattggcccatgaatcacatctaatgctgacagctcctcatggactccagagctcagaagtccaagatacactgaagctttgtccacgtgatcagttttgtaagataaagacagaaagggcaaaagagatatatccagtgatggagaaggagggacgaacacgtctggctctcatcatctgcaacaaaaagtttgactacctttttgatagagataatgctgatactgacattttgaacatgcaagaactacttgaaaatcttggatactctgtggtgttaaaggaaaaccttacagctcaggaaatggagacagagttaatgcagtttgctggccgtccagagcaccagtcctcagacagcacattcctggtgtttatgtcccatggcatcctggaaggaatctgtggggtgaagcaccgaaacaaaaagccagatgttcttcatgatgacactatcttcaaaattttcaacaactctaactgtcggagtctgagaaacaaacccaagattctcatcatgcaggcctgcagaggcagatataatggaactatttgggtatccacaaacaaagggatagccactgctgatacagatgaggaacgtgtgttgagctgtaaatggaataatagtataacaaaggcccatgtggagacagatttcattgctttcaaatcttctaccccacataatatttcttggaaggtaggcaagactggttccctcttcatttccaaactcattgactgcttcaaaaagtactgttggtgttatcatttggaggaaatttttcgaaaggttcaacactcatttgaggtcccaggtgaactgacccagatgcccactattgagagagtatccatgacacgctatttctacctttttcccgggaattagcacaggcaactctcatgcagttcccagtcaagtattgctgtagctgagaagaaaagaaaattccaagatcccaggatttttaaatgtgtaaaacttttcagttagatattttatacaatatcataaggctagataatttccataggttatttttaggggaaacctgatacgtaaaattttgcatgaaaagtatagattcgttccttccttccaaatctgctcatcttttactttattttattaaatttatatttgcacatttttgtaaaatgaataaaggaaaaagacactaaagaacatgtctgaacatatcctggaacttcttctttgtaaaatgaataaaggaaaaagacactaaagaacaaagatgatacaccttttgatgaaccactttcacctataaattagtagtaagaatttactcacaaggaagatcttatctacaatgtagctgagaaatgaaactgttgcatatgtaggtaaaactaatcatcttttaggaataagataaagaggtttatgtccactgtttgtctctggcatacatggttttcatgcctagtggctacctaccattcctttcaatcaatttcttaggatataattgacaaatttatgctatgtttataatttttctcttaaatgcctttgtaataagatatactcacacatacacatttaagattctgtctattagtgttattgaaataaatcctagaaacaaaaattaaaagtttaaagcattaaagacaattttgagacaaaatattctatgaaattctatgcaaaattgaattcttctacaagtatgtgatgaagcccacctaccactatttttgtcatcttgaggatgttatatcattatttttacttaactgagctcaaattaaaatctttgtttattctttgttctataaaaaaaaaaaaaaaaaaaa

SEQ ID NO: 359 - protein, 339 aa, Drosophila melanogaster
  Caspase precursor (insect) C14.015
MDATNNGESADQVGIRVGNPEQPNDHTDALGSVGSGGAGSSGLVAGSSHPYGSGAIGQLANGYSSPSSSYRKNVAKMVTDRHAAEYNMRHKNRGMALIFNHEHFEVPTLKSRAGTNVDCENLTRVLKQLDFEVTVYKDCRYKDILRTIEYAASQNHSDSDCILVAILSHGEMGYIYAKDTQYKLDNIWSFFTANHCPSLAGKPKLFFIQACQGDRLDGGVTMQRSQTETDGDSSMSYKIPVHADFLIAYSTVPGFYSWRNTTRGSWFMQSLCAELAANGKRLDILTLLTFVCQRVAVDFESCTPDTPEMHQQKQIPCITTMLTRILRFSDKQLAPAGRV

SEQ ID NO: 360 - DNA, 1020 bp, Drosophila melanogaster
  Caspase precursor (insect) C14.015
atggacgccactaacaatggagaatccgccgaccaggtgggcatcagggtgggcaatccggagcagcccaacgatcacacagatgccctgggctccgtgggatccggaggagcgggtagcagcggcctggtcgcaggatcctcgcatccttacggcagcggagccattgggcagctggccaacgggtacagctcaccctcgtccagctaccgaaagaatgtagccaaaatggtcaccgaccgccatgcagccgagtacaacatgcgccacaagaaccgcggaatggcactgatcttcaaccatgagcacttcgaggtgcccaccttgaagtcccgcgcgggaaccaatgtggactgcgagaatctgactcgggtgctcaagcagctggacttcgaagtgaccgtgtacaaggactgccgctacaaggacattttgaggacaatcgagtattcagcgtcgcagaatcacagcgatagtgattgcatcctggtcgccatcctgtcgcacggcgagatgggctacatctacgccaaggacacacagtacaagctggataacatctggagcttcttcacggccaatcactgcccctcgctagccggcaaacccaagttgttcttcatacaggcctgccagggcgacagattggatggcggagtgaccatgcagcgttctcagacggaaaccgatggcgactcctcgatgagctacaagattccagtgcacgccgactttctgatcgcctactcgacggttcctggattctattcgtggcgcaacaccacccgcggcacgtggttcatgcagagcctgtgcgccgaactggcggccaatggcaagcggctggacatcctgaccctgctcacattcgtgtgccagcgggtggccgtggactttgagtcctgcaccccggacactccggagatgcaccagcagaagcagataccctgcatcaccaccatgctgacgcgcattctgcgtttcagcgacaagcagttggctccagccggacgggtttga

SEQ ID NO: 361 - protein, 323 aa, Drosophila melanogaster
  Caspase-1 precursor (insect) C14.016
MTDECVTRNYGVGIRSPNGSENRGSFIMADNTDAKGCTPESLVVGGATAASPLPANKFVARMPVERYASEYNMSHKHRGVALIFNHEFFDIPSLKSRTGTNVDAQELKKAFENLGFAVSVHKDCKLRDILKHVGKAAELDHTDNDCLAVAILSHGEHGYLYAKDTQYKLDNIWHYFTATFCPSLAGKPKLFFIQACQGDRLDGGITLEKGVTETDGESSTSYKIPIHADFLFSYSTIPGYFSWRNINNGSWYMQSLIRELNANGKKYDLLTLLTFVNQRVALDFESNVPATPMMDRQKQIPCLTSMLTRILRFGDKPNGNKAG

SEQ ID NO: 362 - DNA, 1757 bp, Drosophila melanogaster
  Caspase-1 precursor (insect) C14.016
agtttgttttcgccgctcagagcacgcttaacctccgttaattgattgattaaacacgtccgactgtgagccataaaaggacattcgctcgatcgaaagccgacaaaagctggctgagaagcgcaaaacagctgcgctgcgcaaagtttggccaacgcagagcaatagaaaacagaagcagtgtcagaataaaacaagaatcagaccaaaaagggcgcaacaactgcggagagagaaaaggaaggaaagagcagcgcgtgacgagggaggagcaggagggagcgaacaaaaggcaagaggaaacacaaggagaaacgcaaacaatcaaaacaagaacttaagcaagaaaaggggcgcaagatgaccgacgagtgcgtaaccagaaactacggagtaggcattcgcagcccaaatggatcggaaaatcggggcagctttataatggctgataataccgatgccaagggctgtacgccggagtctcttgttgttggtggtgcaactgcagcgagccccttgccggccaacaagtttgtggctcgaatgcccgtggaacgatatgcaagcgaatacaacatgagtcacaagcaccgcggagttgcgctgatcttcaaccacgaattcttcgacataccctcgctgaagagccgcaccggaacaaatgtcgatgcccaagagctgaaaaaggcctttgaaaacctgggattcgcggtgtccgtgcacaaggactgcaagttgagggacatcctgaagcacgtggggaaggccgccgagttggaccacacggacaacgactgccttgcggtggccatactctcgcacggggagcacggctacctgtacgccaaggatacgcagtacaagctggacaacatctggcactacttcactgccaccttctgcccctcgctggcgggcaagccgaagctgttcttcatccaagcctgccagggcgatcgcttggacggaggcatcactctggagaagggcgttaccgagacggacggggagtcctcgacgagctacaagatacccatacacgccgactttctcttctcctactcgaccattccgggctacttctcctggcgcaacatcaacaatggctcctggtacatgcaatcgctgatccgcgagctgaacgccaatggcaaaaagtacgacctgctcaccctgcttacattcgttaaccagcgcgtagccctagactttgagtcgaacgtgcccgccacaccgatgatggatcgccagaagcaaataccgtgcctcacctccatgctgacgcgcatactgcgcttcggcgacaagccgaacggcaataaggctggctaggaagagatctcccttcgaagaagaactttcaacagaggttgtacaaccatcgcccgcaatcattcacgttggattccaattcacttcaagtttagttttagctgacgcgtgcgattaacccgatggatattgaagcacccgactccctttcattcattcccctgcctttcccatgcccatttcggccttatcattgacgaaattcgttacccatttacccactagatgacttccgtatgcataagcgagaccttgccaatagaaaacccacaaatttgagataagataatacaatgaagatttatacatacatacatacttttatgtacacgcaaacatttatatttgatatgaataaaaatgaattaaaaacataaaaaaaaaaaaaaaaaaaaaaaaaaaaacaaaaaaaaaaaaaaaaaaaa

SEQ ID NO: 363 - protein, 377 aa, Bos taurus
  Caspase-13 precursor C14.017
MAEDKHNKNPLKMLESLGKELISGLLDDFVEKNVLKLEEEEKKKIYDAKLQDKARVLVDSIRQKNQEAGQVFVQTFLNIDKNSTSIKAPEETVAGPDESVGSAATLKLCPHEEFLKLCKERAGEIYPIKERKDRTRLALIICNTEFDHMPPRNGAALDILGMKQLLEGLGYTVEVEEKLTARDMESVLWKFAAREEHKSSDSTFLVFMSHGILDGICGTMHSEEEPDVLPYDTIFRTFNNRNCLSLKDKPKVIIVQACRGANRGELWVSDSPPALADSFSQSSENLEEDAVYKTHVEKDFIAFCSSTPHNVSWRDIKKGSLFITRLITCFQKYAWCCHLEEVFRKVQQSFEKPNVKAQMPTVERLSMTRYFYLFPGN

SEQ ID NO: 364 - DNA, 2060 bp, Homo sapiens
  Caspase-13 precursor C14.017
ccacgcgtccgcggacgcgtgggctccttcaaggcagtaggaagatactaagcttattatctatggctgaagacaaacacaacaaaaacccacttaagatgttggaatctttgggcaaagaactcatttctggccttttggatgactttgtggaaaaaaatgtcctgaaattggaggaagaggagaagaaaaaaatttatgatgccaaacttcaagacaaagcccgggtcttggttgattctatacgacagaaaaaccaagaggcaggtcaagtctttgttcaaactttcctaaacatagacaaaaattccaccagtataaaagctcctgaggaaactgtggctggaccagatgagtcagtgggatctgcagctaccctcaagctttgccctcatgaagaattcctgaaactgtgtaaagaaagggctggagagatctatccaataaaggagagaaaggaccgcactcgtctggctctcatcatatgcaacacagagtttgatcatatgcctcccaggaatggggctgcccttgacatccttggaatgaagcagctgcttgagggtcttggctacactgtggaagtggaagagaaactcacagccagggacatggaatcagtgctgtggaaatttgctgcacgtgaagagcacaaatcctcagacagtacattcttggtgttcatgtctcatggcatcctggatgggatctgtgggactatgcacagtgaggaagaaccagatgtgttaccttatgataccatcttccggacattcaacaaccgtaattgcctcagtctaaaggacaaacctaaagtcatcattgtccaggcctgcagaggtgcaaatcgtggggaattgtgggtcagtgactctccaccagccttggcagacagcttttcacagtcatccgagaacctggaagaggatgctgtttacaagacccatgtagagaaggacttcattgctttctgttcctcaactccacataatgtgtcctggagagacataaaaaaaggttctctcttcattacacgactcatcacatgcttccaaaaatatgcttggtgctgtcatcttgaggaagtatttaggaaggtacaacaatcatttgaaaaaccaaatgttaaagcccagatgcccactgttgaacgactctctatgacaagatatttctacctctttcctggcaactgaaaataaaaatcacaggaaattcaaccatttatcagcttcaagaagcatttttatcagcacagcatccatgtttaaccttttgtctttcattaaagtgaaaacatatgaactgttctttggggtcctctaagaaagaatagaatttcaattaaaacaatggatggatggaaataaagtagaagaagaaaactggattttcttgttatattgcatataatgcctgcactttactgagtgaagagaactagtcatgacttgccctcagcagcagggtgaaaggagatggtgcacatctggagacaaggaccaaaaactgggtcacctgctcctttgatcactcatcaaaccttgcaactagaattatttggaagaatatttctaatttattatttaaccaacatcataggtcaagttcaattttttttcagaaagttgttatggtacctatgcatctttcttcttatccataaattaatttgctttcttgttgatgatttttcattccagatttccaagcttcaggaaaattttgttatttagcaaacacttggtaattgtctaaaataaattgggcctttgatttaagatggtataattgggtgtgcttgtatagaaagacagacattattagatacagaacatccaagagtgtgggaaatgtcagcaatgggaaagaaaatgttaaattttctggaaagtgaatgtcagtagaggaattttagcaacatggccatctgagccactgactaaggagatgtaccacttcaattacatacatgcagaatgctgaatagatatatcaggacatgctgaactgtattacaaataaaatgattctctagatatcaaaaaaaaaaaaaaaaa

SEQ ID NO: 365 - protein, 242 aa, Homo sapiens
  Caspase-14 precursor C14.018
MSNPRSLEEEKYDMSGARLALILCVTKAREGSEEDLDALEHMFRQLRFESTMKRDPTAEQFQEELEKFQQAIDSREDPVSCAFVVLMAHGREGFLKGEDGEMVKLENLFEALNNKNCQALRAKPKVYIIQACRGEQRDPGETVGGDEIVMVIKDSPQTIPTYTDALHVYSTVEGYIAYRHDQKGSCFIQTLVDVFTKRKGHILELLTEVTRRMAEAELVQEGKARKTNPEIQSTLRKRLYLQ

SEQ ID NO: 366 - DNA, 777 bp, Homo sapiens
  Caspase-14 precursor C14.018
aggatcagacaagggtgctgagagccgggactcacaaccaaaggagaaatgagcaatccgcggtctttggaagaggagaaatatgatatgtcaggtgcccgcctggccctaatactgtgtgtcaccaaagcccgggaaggttccgaagaagacctggatgctctggaacacatgtttcggcagctgagattcgaaagcaccatgaaaagagaccccactgccgagcaattccaggaagagctggaaaaattccagcaggccatcgattcccgggaagatcccgtcagttgtgccttcgtggtactcatggctcacgggagggaaggcttcctcaagggagaagatggggagatggtcaagctggagaatctcttcgaggccctgaacaacaagaactgccaggccctgcgagctaagcccaaggtgtacatcatacaggcctgtcgaggagaacaaagggaccccggtgaaacagtaggtggagatgagattgtgatggtcatcaaagacagcccacaaaccatcccaacatacacagatgccttgcacgtttattccacggtagagggatacatcgcctaccgacatgatcagaaaggctcatgctttatccagaccctggtggatgtgttcacgaagaggaaaggacatatcttggaacttctgacagaggtgacccggcggatggcagaagcagagctggttcaagaaggaaaagcaaggaaaacgaaccctgaaatccaaagcaccctccggaaacggctgtatctgcagtag

SEQ ID NO: 367 - protein, 450 aa, Drosophila melanogaster
  Caspase Nc precursor C14.019
MQPPELEIGMPKRHREHIRKNLNILVEWTNYERLAMECVQQGILTVQMLRNTQDLNGKPFNMDEKDVRVEQHRRLLLKITQRGPTAYNLLINALRNINCLDAAVLLESVDESDSRPPFISLNERRTSRKSADIVDTPSPEASEGPCVSKLRNEPLGALTPYVGVVDGPEVKKSKKIHGGDSAILGTYKMQSRFNRGVLLMVNIMDYPDQNRRRIGAEKDSKSLIHLFQELNFTIFPYGNVNQDQFFKLLTMVTSSSYVQNTECFVMVLMTHGNSVEGKEKVEFCDGSVVDMQKIKDHFQTAKCPYLVNKPKVLMFPFCRGDEYDLGHPKNQGNLMEPVYTAQEEKWPDTQTEGIPSPSTNVPSLADTLVCYANTPGYVTHRDLDTGSWYIQKFCQVMADHAHDTDLEDILKKTSEAVGNKRTKKGSMQTGAYDNLGFNKKLYFNPGFFNE

SEQ ID NO: 368 - DNA, 2090 bp, Drosophila melanogaster
  Caspase Nc precursor C14.019
tttggcggcgcgaaacgctcgttggtccttttgtttcgaaagaaatcctattcgaagatccccgatccttgctaggatcatctagtgcaatatatagactagttaatttacttttggaaaaataaggacaccagcagggccgccgatttgtgcccctttcttgaaagtcgcaaaacaaaaacaacgacgacaacaacaaagcggagacaaagaatcgacaagtagcgataaacgaaatcattcccgggaaaaccttggagacgggtgattcactgccaataccactgccaattggagactgatcacggcagccatccttggcgcgcccaataagcggagtcaccggaacgcgtggaagccatatccggaatgcagccgccggagctcgagattggaatgccgaagaggcatcgcgagcatatacgcaagaatctgaatatactggttgaatggacgaactacgagcgtctggccatggagtgcgtgcaacagggcatcctaaccgttcagatgctaagaaatacgcaggatctcaatggcaagccattcaacatggacgagaaggatgtgcgtgtggagcagcatcgtaggctcctattgaagatcacccagcgtggtcccaccgcctataacctgctgatcaatgcactgcgcaatatcaattgtctggatgcggccgttctattggaatccgtcgatgagtccgattcaaggccaccctttatctcgctaaacgaacggagaaccagccggaagtcggccgatattgtggacacaccctcacccgaagcctccgaaggaccctgcgttagcaagctccggaatgagccgctgggagcactcaccccttatgtgggtgtcgttgacggtcccgaggtaaaaaaatcgaaaaagatacatggtggggatagtgccatattgggcacatataagatgcaatcacgtttcaaccgaggcgttttgctaatggttaacataatggactatccggatcaaaaccgtcgacggatcggagccgaaaaggacagcaagtcgttgatacacttgtttcaagaactgaattttacgattttcccctatgggaacgtgaatcaggatcagttctttaaacttctgacaatggtgacctcctcgtcgtatgtgcagaataccgagtgtttcgtaatggtactgatgacacacggcaacagtgtggagggaaaagagaaggtggagttttgcgatggatctgtggtcgatatgcagaagatcaaggaccatttccagacggccaaatgtccttatttggtgaacaagccgaaggtgcttatgtttcccttttgccgcggcgatgaatatgatttgggccatccaaagaatcaaggcaatctcatggagccagtgtatacggcgcaagaggagaagtggcctgacacccagacggagggcatacccagcccgagcaccaatgtgccaagtcttgccgacactctggtctgctatgctaatacgccgggctatgttacccaccgcgatctcgacacgggcagctggtacatccagaagttttgccaagtgatggccgatcatgcccacgacacagaccttgaggatatcctaaagaagacgagcgaagccgtgggtaataagcgcaccaagaagggttccatgcagacaggtgcctatgataatcttggctttaataagaaactctacttcaatcccgggtttttcaacgaatagttgccgccactggacattttatcattccggatgcatttttaaccgcatttatgttcttatcgtcgcatttagtatgtcttttagattatgtgttctgtgctcgcgtgctataaaatgtttatattgtaacaaatactcattcaagtattcttctaatacgtattgcatacctcatttaaaggtacgaaattatgtaatttatgtgataactgccagaaatctacaaatattataatacagagttccagtatatacacagccagatttttgaaatcgaacatttaggcaaaatgtaaagcaattttccagtctgatttttgagtgtgtacacttacaaaataaacgatgatatttcacaaggcccaaag

SEQ ID NO: 369 - protein, 824 aa, Homo sapiens
  MALT lymphoma translocation protein 1 (paracaspase) C14.026
MSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIGRTDEAVECTEDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 370 - DNA, 2828 bp, Homo sapiens
  MALT lymphoma translocation protein 1 (paracaspase) C14.026
ggggcggggagcggacttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttct

SEQ ID NO: 371 - protein, 480 aa, Homo sapiens
  CASP8 and FADD-like apoptosis regulator precursor (c-FLIP) C14.971
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 372 - DNA, 1443 bp, Homo sapiens
  CASP8 and FADD-like apoptosis regulator precursor (c-FLIP)	      C14.971
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 373 - DNA, 4874 bp, Artificial Sequence
  pCMV4
cccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgatctatacattgaatcaatattggcaattagccatattagtcattggttatatagcataaatcaatattggctattggccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagaattgtttttatttttaattttctttcaaatacttccatcgaattcagatctggtaccacgcgtatcgataagcttgcatgcctgcaggtcgactctagaggatccccgggtggcatccctgtgacccctccccagtgcctctcctggccttggaagttgccactccagtgcccaccagccttgtcctaataaaattaagttgcatcattttgtctgactaggtgtcctctataatattatggggtggaggggggtggtatggagcaaggggcccaagttgggaagacaacctgtagggcctgcggggtctattcgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctgccatggcccaaccggtgggacatttgagttgcttgcttggcactgtcctctcatgcgttgggtccactcagtagatgcctgttgaattgggtacgcggccagcttctgtggaatgtgtgtcagttagggtgtggaaagtccccaggctccccagcaggcagaagtatgcaaagcatgcatctcaattagtcagcaaccaggtgtggaaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctcctcgaggaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgctgcaggtcgactctagggccgcgtaccgagctcgaattccctatagtgagtcgtattaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttc

SEQ ID NO: 374 - DNA, 35 bp, Artificial Sequence
  primer 496
acgtggcccaggcggcctttcagtgtggccaaaag

SEQ ID NO: 375 - DNA, 32 bp, Artificial Sequence
  primer 497
tcctggccggcctggccgagcaggccattctc

SEQ ID NO: 376 - DNA, 4681 bp, Artificial Sequence
  pComb3H phagemid vector
gggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaattgaattcaggaggaatttaaaatgaaaaagacagctatcgcgattgcagtggcactggctggtttcgctaccgtggcccaggcggccgagctcgtgttgacccaatctccagcttctttggctgtgtctctagggcagagggccaccatctcctgcagagccagcgaaagtgttgataattatggcattagttttatgaactggttccaacagaaaccaggacagccacccaaactcctcatctatgctgcatccaacctaggatccggggtccctgccaggtttagtggcagtgggtctgggacagacttcagtctcaacatccatcctatggaggaggaagatactgcaatgtatttctgtcagcaaagtaaggaggttccgctcacgttcggtgctgggaccaaggtggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacatgaatcaccactaatctagataattaattaggaggaatttaaaatgaaatacctattgcctacggcagccgctggattgttattactcgctgcccaaccagccatggccgaggtgcagctgctcgagcagcctgggtctgtgctggtaaggcctggagcttcagtgaagctgtcctgcaaggcttctggctacaccttcaccagctcctggatacactgggcgaagcagaggcctggacaaggccttgagtggattggagagattcatcctaatagtggtaatactaactacaatgagaagttcaagggcaaggccacactgactgtagacacatcctccagcacagcctacgtggatctcagcagcctgacatctgaggactctgcggtctattactgtgcaagatggaggtacggtagtccctactactttgactactggggccaaggcaccactctcactgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgccccatcatactagtggccaggccggccaggagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttagcgctggtaaaccatatgaattttctattgattgtgacaaaataaacttattccgtggtgtctttgcgtttcttttatatgttgccacctttatgtatgtattttctacgtttgctaacatactgcgtaataaggagtcttaagctagctaattaatttaagcggccgcagatct

SEQ ID NO: 377 - DNA, 4361 bp, Artificial Sequence
  PBR322
ttctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaa

SEQ ID NO: 378 - protein, 5 aa, Artificial Sequence
  wildtype RCL sequence from P4-P1
VSARM

SEQ ID NO: 379 - protein, 5 aa, Artificial Sequence
  mutant RCL sequence from P4-P1'
RRARM

SEQ ID NO: 380 - DNA, 44 bp, Artificial Sequence
  RRARM mutagenic primer
ccacagctgtcataaggagggccagaatggcccccgaggagatc

SEQ ID NO: 381 - DNA, 18 bp, Artificial Sequence
  primer 535
cagctatcgcgattgcag

SEQ ID NO: 382 - DNA, 17 bp, Artificial Sequence
  primer 5542
gtgcgcagccatcccgg

SEQ ID NO: 383 - DNA, 19 bp, Artificial Sequence
  variation 8: n = a, g, c, or t
  variation 9: n = a, g, c, or t
  variation 10: s = g or c
  Primer TC30
gccctggnnsgcggccatc

SEQ ID NO: 384 - DNA, 20 bp, Artificial Sequence
  variation 8: n = a, g, c, or t
  variation 9: n = a, g, c, or t
  variation 10: s = g or c
  Primer TC155
ggagcagnnsaaaatgactg

SEQ ID NO: 385 - DNA, 18 bp, Artificial Sequence
  Primer 717
tttcagtgtggccaaaag

SEQ ID NO: 386 - DNA, 18 bp, Artificial Sequence
  Primer 718
cagagtcttttggccaca

SEQ ID NO: 387 - DNA, 35 bp, Artificial Sequence
  Primer 850
ggggtaccgccaccatgagagccctgctggcgcgc

SEQ ID NO: 388 - DNA, 33 bp, Artificial Sequence
  Primer 851
gctctagatcatcagagggccaggccattctct

SEQ ID NO: 389 - protein, 5 aa, Artificial Sequence
  mutant P4-P1' RCL loop sequence
PFGRS

SEQ ID NO: 390 - DNA, 44 bp, Artificial Sequence
  PFGRS mutagenesis primer
ccacagctgtcatacccttcggcagaagcgcccccgaggagatc

SEQ ID NO: 391 - protein, 245 aa, Artificial Sequence
  mature chymotrypsin
CGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 392 - DNA, 10 bp, Artificial Sequence
  Synthetic linker
aattctatgg

SEQ ID NO: 393 - DNA, 10 bp, Artificial Sequence
  Synthetic linker
tgcaccatag

SEQ ID NO: 394 - DNA, 13 bp, Artificial Sequence
  Synthetic linker
atggaaccctgaa

SEQ ID NO: 395 - DNA, 19 bp, Artificial Sequence
  Synthetic linker
agcttcagggttccatcac

SEQ ID NO: 396 - protein, 380 aa, Artificial Sequence
  PAI-I with MET as cloned into pPAIST7HS
MVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 397 - protein, 21 aa, Artificial Sequence
  Manduca sexta serpin 1B RSL loop
EGAEAAAANAFGIVPKSLILY

SEQ ID NO: 398 - protein, 21 aa, Artificial Sequence
  Manduca sexta serpin 1K RSL loop
EGAEAAAANAFKITTYSFHFV

SEQ ID NO: 399 - protein, 21 aa, Artificial Sequence
  1-antichymotrypsin RSL loop
EGTEASAATAVKITLLSALVE

SEQ ID NO: 400 - protein, 21 aa, Artificial Sequence
  Antithrombin-III RSL loop
EGSEAAASTAVVIAGRSLNPN

SEQ ID NO: 401 - protein, 21 aa, Artificial Sequence
  PAI-II RSL loop
EGTEAAAGTGGVMTGRTGHGG

SEQ ID NO: 402 - protein, 21 aa, Artificial Sequence
  1-antitrypsin RSL loop
KGTEAAGAMFLEAIPMSIPPE

SEQ ID NO: 403 - protein, 21 aa, Artificial Sequence
  PAI-I RSL loop
SGTVASSSTAVIVSARMAPEE

SEQ ID NO: 404 - protein, 21 aa, Artificial Sequence
  PAI-III RSL loop
SGTRAAAATGTIFTFRSARLN

SEQ ID NO: 405 - protein, 21 aa, Artificial Sequence
  Ovalbumin RSL loop
AGREVVGSAEAGVDAASVSEE

SEQ ID NO: 406 - protein, 4 aa, Artificial Sequence
  TNF- alpha cleavage sequence
AEAK

SEQ ID NO: 407 - protein, 4 aa, Artificial Sequence
  TNF-R1 cleavage sequence (1)
ENVK

SEQ ID NO: 408 - protein, 4 aa, Artificial Sequence
  TNF-R1 cleavage sequence (2)
GTED

SEQ ID NO: 409 - protein, 4 aa, Artificial Sequence
  TNF-R2 cleavage sequence (1)
SPTR

SEQ ID NO: 410 - protein, 4 aa, Artificial Sequence
  TNF-R2 cleavage sequence (2)
VSTR

SEQ ID NO: 411 - protein, 4 aa, Artificial Sequence
  TNF-R2 cleavage sequence (3)
STSF

SEQ ID NO: 412 - protein, 4 aa, Artificial Sequence
  HER-2 cleavage sequence (1)
KFPD

SEQ ID NO: 413 - protein, 4 aa, Artificial Sequence
  HER-2 cleavage sequence (2)
AEQR

SEQ ID NO: 414 - protein, 4 aa, Artificial Sequence
  EGFR cleavage sequence (1)
KYAD

SEQ ID NO: 415 - protein, 4 aa, Artificial Sequence
  EGFR cleavage sequence (2)
NGPK

SEQ ID NO: 416 - protein, 4 aa, Artificial Sequence
  VEGFR-1 cleavage sequence (1)
SSAY

SEQ ID NO: 417 - protein, 4 aa, Artificial Sequence
  VEGFR-1 cleavage sequence (2)
GTSD

SEQ ID NO: 418 - protein, 4 aa, Artificial Sequence
  VEGFR-2 cleavage sequence (1)
AQEK

SEQ ID NO: 419 - protein, 4 aa, Artificial Sequence
  VEGFR-2 cleavage sequence (2)
RIDY

SEQ ID NO: 420 - protein, 4 aa, Artificial Sequence
  C3 cleavage sequence (1)
REFK

SEQ ID NO: 421 - protein, 4 aa, Artificial Sequence
  C3 cleavage sequence (2)
GLAR

SEQ ID NO: 422 - protein, 4 aa, Artificial Sequence
  C3 cleavage sequence (3)
RLGR

SEQ ID NO: 423 - protein, 4 aa, Artificial Sequence
  C3 cleavage sequence (4)
AEGK

SEQ ID NO: 424 - protein, 4 aa, Artificial Sequence
  C3 cleavage sequence (5)
QHAR

SEQ ID NO: 425 - protein, 4 aa, Artificial Sequence
  C3 cleavage sequence (6)
LPSR

SEQ ID NO: 426 - protein, 4 aa, Artificial Sequence
  C3 cleavage sequence (7)
SLLR

SEQ ID NO: 427 - protein, 4 aa, Artificial Sequence
  C3 cleavage sequence (8)
LGLA

SEQ ID NO: 428 - protein, 4 aa, Artificial Sequence
  C3 cleavage sequence (9)
LSVV

SEQ ID NO: 429 - protein, 4 aa, Artificial Sequence
  C4 cleavage sequence (1)
HRGR

SEQ ID NO: 430 - protein, 4 aa, Artificial Sequence
  C2 cleavage sequence (1)
GATR

SEQ ID NO: 431 - protein, 4 aa, Artificial Sequence
  C2 cleavage sequence (2)
SLGR

SEQ ID NO: 432 - protein, 4 aa, Artificial Sequence
  C2 cleavage sequence (3)
VFAK

SEQ ID NO: 433 - protein, 411 aa, Artificial Sequence
  urokinase plasminogen activator (uPA) preproprotein
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 434 - protein, 411 aa, Artificial Sequence
  AR73 F173I; F30I (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWIAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 435 - protein, 411 aa, Artificial Sequence
  AR81 L224A, I240V; L73A, I89V (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 436 - protein, 411 aa, Artificial Sequence
  AR1 L224P; L73P (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRPNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 437 - protein, 411 aa, Artificial Sequence
  AR3 R378C; R217C (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGCGCALKDKPGVYTRVSHFLPWIRSHTKEENGLAL

SEQ ID NO: 438 - protein, 411 aa, Artificial Sequence
  AR4 L312P; L155P (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQPKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 439 - protein, 411 aa, Artificial Sequence
  AR7 S226P, I240V, I298T; S75P, I89V, I138T (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNPNTQGEMKFEVENLVLHKDYSADTLAHHNDIALLKIRSKEGRCAQPSRTIQTICLPSMYNDPQFGTSCETTGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 440 - protein, 411 aa, Artificial Sequence
  AR32 E294G; E137G (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCGITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 441 - protein, 411 aa, Artificial Sequence
  AR36 R223G, L312P; R72G, L155P (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSGLNSNTQGEMKFEVENLILHKDYSADTLAHHNDIALLKIRSKEGRCAQPSRTIQTICLPSMYNDPQFGTSCEITGFGKENSTDYLYPEQPKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 442 - protein, 411 aa, Artificial Sequence
  AR37 G290D; G133D (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFDTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 443 - protein, 411 aa, Artificial Sequence
  AR66 V317A; V160A (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVAKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 444 - protein, 411 aa, Artificial Sequence
  AR24 V185D; V38D (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSDTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 445 - protein, 411 aa, Artificial Sequence
  AR85 F289L, V317A; F132L, V160A (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQLGTSCEITGFGKENSTDYLYPEQLKMTVAKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 446 - protein, 411 aa, Artificial Sequence
  ARF2 F173T, L224A, I240V; F30T, L73A, I189V (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWTAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 447 - protein, 411 aa, Artificial Sequence
  ARF6 F173L, L224A, I240V; F30L, L73A, I189V  (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWLAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 448 - protein, 411 aa, Artificial Sequence
  ARF11 F173V, L224A, I240V; F30V, L73A, I189V  (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 449 - protein, 411 aa, Artificial Sequence
  ARF17 F173G, L224A, I240V; F30G, L73A, I189V  (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWGAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 450 - protein, 411 aa, Artificial Sequence; identical to SEQ ID NO: 447
  ARF16 F173L, L224A, I240V; F30L, L73A, I189V  (CHYM SYSTEM)

SEQ ID NO: 451 - protein, 411 aa, Artificial Sequence
  ARF33 L224A, I240V, L312V; L155V, L73A, I189V  (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQVKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 452 - protein, 411 aa, Artificial Sequence
  ARF35 F173M, L224A, I240V; F30M, L73A, I189V  (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWMAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 453 - protein, 411 aa, Artificial Sequence
  ARF36 L224A, L312M; L155M, L73A, I189V  (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQMKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 454 - protein, 411 aa, Artificial Sequence; identical to SEQ ID NO: 452
  ARF37 F173M, L224A, I240V; F30M, L73A, I189V  (CHYM SYSTEM)

SEQ ID NO: 455 - protein, 411 aa, Artificial Sequence; identical to SEQ ID NO: 447
  ARF43 F173L, L224A, I240V; F30L, L73A, I189V  (CHYM SYSTEM)

SEQ ID NO: 456 - protein, 411 aa, Artificial Sequence; identical to SEQ ID NO: 448
  ARF47 F173V, L224A, I240V; F30V, L73A, I189V  (CHYM SYSTEM)

SEQ ID NO: 457 - protein, 411 aa, Artificial Sequence
  ARF48 F173L, L224A, I240V, L312M; F30L, L155M, L73A, I189V  (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWLAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQMKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 458 - protein, 411 aa, Artificial Sequence; identical to SEQ ID NO: 447
  ARF103 F173L, L224A, I240V; F30L, L73A, I189V  (CHYM SYSTEM)

SEQ ID NO: 459 - protein, 411 aa, Artificial Sequence
  ARF115 F173G, L224A, I240V, L312M; F30G, L155M, L73A, I189V  (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWGAAIYRRHRGGSVTYVCGGSLISPCWVISATHCFIDYPKKEDYIVYLGRSRANSNTQGEMKFEVENLVLHKDYSADTLAHHNDIALLKIRSKEGRCAQPSRTIQTICLPSMYNDPQFGTSCEITGFGKENSTDYLYPEQMKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 460 - protein, 411 aa, Artificial Sequence
  uPA/Ia  F164V; F21V (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEVTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 461 - protein, 411 aa, Artificial Sequence
  uPA/Ib  I167L; I24L (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTLENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 462 - protein, 411 aa, Artificial Sequence
  uPA/Ic F173V; F30V (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 463 - protein, 411 aa, Artificial Sequence
  uPA/Id F173L; F30L (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWLAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 464 - protein, 411 aa, Artificial Sequence
  uPA/IIa F173V, Y209H; F30V, Y61aH (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDHPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 465 - protein, 411 aa, Artificial Sequence
  uPA/IIb F173V, K233E; F30V, K82E (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDYPKKEDYIVYLGRSRLNSNTQGEMEFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 466 - protein, 411 aa, Artificial Sequence
  uPA/IIc F173V, K313T; F30V, K156T (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLTMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 467 - protein, 411 aa, Artificial Sequence
  uPA/IIIa F173V, K233E, V316A; F30V, K82E, V159A (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDYPKKEDYIVYLGRSRLNSNTQGEMEFEVENLILHKDYSADTLAHHNDIALLKIRSKEGRCAQPSRTIQTICLPSMYNDPQFGTSCEITGFGKENSTDYLYPEQLKMTAVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 468 - protein, 411 aa, Artificial Sequence
  uPA/IIIb F173V, K233E, T186A, V316A; F30V, K82E, 39A, V159A (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVAYVCGGSLISPCWVISATHCFIDYPKKEDYIVYLGRSRLNSNTQGEMEFEVENLILHKDYSADTLAHHNDIALLKIRSKEGRCAQPSRTIQTICLPSMYNDPQFGTSCEITGFGKENSTDYLYPEQLKMTAVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 469 - protein, 411 aa, Artificial Sequence
  uPA/IIIc F173V, K233E, T315A, V316A; F30V, K82E, T158A, V159A (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDYPKKEDYIVYLGRSRLNSNTQGEMEFEVENLILHKDYSADTLAHHNDIALLKIRSKEGRCAQPSRTIQTICLPSMYNDPQFGTSCEITGFGKENSTDYLYPEQLKMAAVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 470 - protein, 411 aa, Artificial Sequence
  uPA/IIId F173V, Y209H, K243E; F173V, Y61aH, K92E (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDHPKKEDYIVYLGRSRLNSNTQGEMKFEVENLILHEDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 471 - protein, 411 aa, Artificial Sequence
  uPA/IVa F173V, K233E, V316A, G231E, I240V, K348E; F173V, K82E, V159A, E80G, I89V, K187E (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDYPKKEDYIVYLGRSRLNSNTQGGMEFEVENLVLHKDYSADTLAHHNDIALLKIRSKEGRCAQPSRTIQTICLPSMYNDPQFGTSCEITGFGKENSTDYLYPEQLKMTAVKLISHRECQQPHYYGSEVTTKMLCAADPQWETDSCQGDSGGPLVCSLQGRMTLTGIVSWGRGCALKDKPGVYTRVSHFLPWIRSHTKEENGLAL

SEQ ID NO: 472 - protein, 411 aa, Artificial Sequence
  uPA/IVb F173V, K233E, V316A, G231E, E235K, I240V, K348E; F173V, K82E, V159A, E80G, E89K, I89V, K187E (CHYM SYSTEM)
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWVAAIYRRHRGGSVTYVCGGSLISPCWVISATHCFIDYPKKEDYIVYLGRSRLNSNTQGGMEFKVENLVLHKDYSADTLAHHNDIALLKIRSKEGRCAQPSRTIQTICLPSMYNDPQFGTSCEITGFGKENSTDYLYPEQLKMTAVKLISHRECQQPHYYGSEVTTKMLCAADPQWETDSCQGDSGGPLVCSLQGRMTLTGIVSWGRGCALKDKPGVYTRVSHFLPWIRSHTKEENGLAL

SEQ ID NO: 473 - protein, 299 aa, Autographa californica nucleopolyhedrovirus
  P35 peptide
MCVIFPVEIDVSQTIIRDCQVDKQTRELVYINKIMNTQLTKPVLMMFNISGPIRSVTRKNNNLRDRIKSKVDEQFDQLERDYSDQMDGFHDSIKYFKDEHYSVSCQNGSVLKSKFAKILKSHDYTDKKSIEAYEKYCLPKLVDERNDYYVAVCVLKPGFENGSNQVLSFEYNPIGNKVIVPFAHEINDTGLYEYDVVAYVDSVQFDGEQFEEFVQSLILPSSFKNSEKVLYYNEASKNKSMIYKALEFTTESSWGKSEKYNWKIFCNGFIYDKKSKVLYVKLHNVTSALNKNVILNTIK

SEQ ID NO: 474 - DNA, 2105 bp, Homo sapiens
  Full length u-PA
atgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactggtgaaatagataagtcaaaaacctgctatgaggggaatggtcacttttaccgaggaaaggccagcactgacaccagttgccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttgagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctatgtgctgctgacccccaatggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggttttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctatgtgctgctgacccccaatggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctgccctctgagggt

SEQ ID NO: 475 - DNA, 804 bp, Homo sapiens
  uPA protease domain
tttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctatgtgctgctgacccccaatggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctgccctctgagggt

SEQ ID NO: 476 - DNA, 22 bp, Artificial Sequence
  Primer UPAF1
atgagagccctgctggcgcgcc

SEQ ID NO: 477 - DNA, 19 bp, Artificial Sequence
  Primer UPAF2
ggaaaagagaattctaccg

SEQ ID NO: 478 - protein, 6 aa, Artificial Sequence
  Synthesized protease cleavage site
IAGRSL

SEQ ID NO: 479 - protein, 6 aa, Artificial Sequence
  Synthesized protease cleavage site
SLGRKI

SEQ ID NO: 480 - protein, 4 aa, Artificial Sequence
  Synthesized protease cleavage site
VLKD

SEQ ID NO: 481 - protein, 4 aa, Artificial Sequence
  Synthesized protease cleavage site
LVED

SEQ ID NO: 482 - protein, 4 aa, Artificial Sequence
  Synthesized protease cleavage site
WFKD

SEQ ID NO: 483 - protein, 4 aa, Artificial Sequence
  Synthesized protease cleavage site
RIYD

SEQ ID NO: 484 - protein, 4 aa, Artificial Sequence
  Synthesized protease cleavage site
KVGR

SEQ ID NO: 485 - protein, 4 aa, Artificial Sequence
  Synthesized protease cleavage site
RVRK

SEQ ID NO: 486 - protein, 4 aa, Artificial Sequence
  Synthesized protease cleavage site
RKTK

SEQ ID NO: 487 - protein, 4 aa, Artificial Sequence
  Synthesized protease cleavage site
KTKK

SEQ ID NO: 488 - protein, 4 aa, Artificial Sequence
  Synthesized protease cleavage site
TKKR

SEQ ID NO: 489 - protein, 4 aa, Artificial Sequence
  Synthesized protease cleavage site
RRVR

SEQ ID NO: 490 - protein, 1474 aa, Homo sapiens
  Alpha-2-macroglobulin precursor (Alpha-2-M)
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEVKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 491 - protein, 439 aa, Spodoptera litura nucleopolyhedrovirus
MCVLIPTFDASATTIVDCANLSDSSLRDLIYVNNVAVSKTGNYINRSVIMALNISGPVVSVNRVSMHIVHMYRSHIDRIFDRFNRLTYSATVTDGGDIDRVLKSDDYTVVCMSRSELLDNYKKCLINEMGATQDDVEKFRKYCLKPLVETENDGGVEDRKKPYVVICSLKPKLLNKNKTLCFTYKPQTGQVIVPLMHEINENGSDVYSYEVMAMIKDVRLSNKPLSMLERLKRSMDQIVLNHNENKYMMTNQLESLKYYLKSINSNEDDDLNKLMNVLNNLIDQLEKVLHKKSICDFSDDDEDDDGLIDMKYYNSIIEDNMRILLMKIQQYIDDRHMFLSPPLSVEKSTKIRLFENVMSFMKRFNLGELYSYLKKIIDWKTHENNQKLAWPEIVDDKYAFLKYDYFGTPHGFVYDQKDRTMYVKLHCGIAANRNIYIDI

SEQ ID NO: 492 - protein, 341 aa, Cowpox virus
MDIFREIASSMKGENVFISPPSISSVLTILYYGANGSTAEQLSKYVEKEADKNKDDISFKSMNKVYGRYSAVFKDSFLRKIGDNFQTVDFTDCRTVDAINKCVDIFTEGKINPLLDEPLSPDTCLLAISAVYFKAKWLMPFEKEFTSDYPFYVSPTEMVDVSMMSMYGEAFNHASVKESFGNFSIIELPYVGDTSMVVILPDNIDGLESIEQNLTDTNFKKWCDSMDAMFIDVHIPKFKVTGSYNLVDALVKLGLTEVFGSTGDYSNMCNSDVSVDAMIHKTYIDVNEEYTEAAAATCALVADCASTVTNEFCADHPFIYVIRHVDGKILFVGRYCSPTTN

SEQ ID NO: 493 - protein, 432 aa, Homo sapiens [sequence omitted]

SEQ ID NO: 494 - DNA, 9765 bp, Artificial Sequence
  pAcGP67b vector
aagctttactcgtaaagcgagttgaaggatcatatttagttgcgtttatgagataagattgaaagcacgtgtaaaatgtttcccgcgcgttggcacaactatttacaatgcggccaagttataaaagattctaatctgatatgttttaaaacacctttgcggcccgagttgtttgcgtacgtgactagcgaagaagatgtgtggaccgcagaacagatagtaaaacaaaaccctagtattggagcaataatcgatttaaccaacacgtctaaatattatgatggtgtgcattttttgcgggcgggcctgttatacaaaaaaattcaagtacctggccagactttgccgcctgaaagcatagttcaagaatttattgacacggtaaaagaatttacagaaaagtgtcccggcatgttggtgggcgtgcactgcacacacggtattaatcgcaccggttacatggtgtgcagatatttaatgcacaccctgggtattgcgccgcaggaagccatagatagattcgaaaaagccagaggtcacaaaattgaaagacaaaattacgttcaagatttattaatttaattaatattatttgcattctttaacaaatactttatcctattttcaaattgttgcgcttcttccagcgaaccaaaactatgcttcgcttgctccgtttagcttgtagccgatcagtggcgttgttccaatcgacggtaggattaggccggatattctccaccacaatgttggcaacgttgatgttacgtttatgcttttggttttccacgtacgtcttttggccggtaatagccgtaaacgtagtgccgtcgcgcgtcacgcacaacaccggatgtttgcgcttgtccgcggggtattgaaccgcgcgatccgacaaatccaccactttggcaactaaatcggtgacctgcgcgtcttttttctgcattatttcgtctttcttttgcatggtttcctggaagccggtgtacatgcggtttagatcagtcatgacgcgcgtgacctgcaaatctttggcctcgatctgcttgtccttgatggcaacgatgcgttcaataaactcttgttttttaacaagttcctcggttttttgcgccaccaccgcttgcagcgcgtttgtgtgctcggtgaatgtcgcaatcagcttagtcaccaactgtttgctctcctcctcccgttgtttgatcgcgggatcgtacttgccggtgcagagcacttgaggaattacttcttctaaaagccattcttgtaattctatggcgtaaggcaatttggacttcataatcagctgaatcacgccggatttagtaatgagcactgtatgcggctgcaaatacagcgggtcgccccttttcacgacgctgttagaggtagggcccccattttggatggtctgctcaaataacgatttgtatttattgtctacatgaacacgtatagctttatcacaaactgtatattttaaactgttagcgacgtccttggccacgaaccggacctgttggtcgcgctctagcacgtaccgcaggttgaacgtatcttctccaaatttaaattctccaattttaacgcgagccattttgatacacgtgtgtcgattttgcaacaactattgttttttaacgcaaactaaacttattgtggtaagcaataattaaatatgggggaacatgcgccgctacaacactcgtcgttatgaacgcagacggcgccggtctcggcgcaagcggctaaaacgtgttgcgcgttcaacgcggcaaacatcgcaaaagccaatagtacagttttgatttgcatattaacggcgattttttaaattatcttatttaataaatagttatgacgcctacaactccccgcccgcgttgactcgctgcacctcgagcagttcgttgacgccttcctccgtgtggccgaacacgtcgagcgggtggtcgatgaccagcggcgtgccgcacgcgacgcacaagtatctgtacaccgaatgatcgtcgggcgaaggcacgtcggcctccaagtggcaatattggcaaattcgaaaatatatacagttgggttgtttgcgcatatctatcgtggcgttgggcatgtacgtccgaacgttgatttgcatgcaagccgaaattaaatcattgcgattagtgcgattaaaacgttgtacatcctcgcttttaatcatgccgtcgattaaatcgcgcaatcgagtcaagtgatcaaagtgtggaataatgttttctttgtattcccgagtcaagcgcagcgcgtattttaacaaactagccatcttgtaagttagtttcatttaatgcaactttatccaataatatattatgtatcgcacgtcaagaattaacaatgcgcccgttgtcgcatctcaacacgactatgatagagatcaaataaagcgcgaattaaatagcttgcgacgcaacgtgcacgatctgtgcacgcgttccggcacgagctttgattgtaataagtttttacgaagcgatgacatgacccccgtagtgacaacgatcacgcccaaaagaactgccgactacaaaattaccgagtatgtcggtgacgttaaaactattaagccatccaatcgaccgttagtcgaatcaggaccgctggtgcgagaagccgcgaagtatggcgaatgcatcgtataacgtgtggagtccgctcattagagcgtcatgtttagacaagaaagctacatatttaattgatcccgatgattttattgataaattgaccctaactccatacacggtattctacaatggcggggttttggtcaaaatttccggactgcgattgtacatgctgttaacggctccgcccactattaatgaaattaaaaattccaattttaaaaaacgcagcaagagaaacatttgtatgaaagaatgcgtagaaggaaagaaaaatgtcgtcgacatgctgaacaacaagattaatatgcctccgtgtataaaaaaaatattgaacgatttgaaagaaaacaatgtaccgcgcggcggtatgtacaggaagaggtttatactaaactgttacattgcaaacgtggtttcgtgtgccaagtgtgaaaaccgatgtttaatcaaggctctgacgcatttctacaaccacgactccaagtgtgtgggtgaagtcatgcatcttttaatcaaatcccaagatgtgtataaaccaccaaactgccaaaaaatgaaaactgtcgacaagctctgtccgtttgctggcaactgcaagggtctcaatcctatttgtaattattgaataataaaacaattataaatgctaaatttgttttttattaacgatacaaaccaaacgcaacaagaacatttgtagtattatctataattgaaaacgcgtagttataatcgctgaggtaatatttaaaatcattttcaaatgattcacagttaatttgcgacaatataattttattttcacataaactagacgccttgtcgtcttcttcttcgtattccttctctttttcatttttctcctcataaaaattaacatagttattatcgtatccatatatgtatctatcgtatagagtaaattttttgttgtcataaatatatatgtcttttttaatggggtgtatagtaccgctgcgcatagtttttctgtaatttacaacagtgctattttctggtagttcttcggagtgtgttgctttaattattaaatttatataatcaatgaatttgggatcgtcggttttgtacaatatgttgccggcatagtacgcagcttcttctagttcaattacaccattttttagcagcaccggattaacataactttccaaaatgttgtacgaaccgttaaacaaaaacagttcacctcccttttctatactattgtctgcgagcagttgtttgttgttaaaaataacagccattgtaatgagacgcacaaactaatatcacaaactggaaatgtctatcaatatatagttgctgatatcatggagataattaaaatgataaccatctcgcaaataaataagtattttactgttttcgtaacagttttgtaataaaaaaacctataaatattccggattattcataccgtcccaccatcgggcgcggatctatgctactagtaaatcagtcacaccaaggcttcaataaggaacacacaagcaagatggtaagcgctattgttttatatgtgcttttggcggcggcggcgcattctgcctttgcggcggatcttggatcccgggccatgggaattccggagcggccgctgcagatctgatcctttcctgggacccggcaagaaccaaaaactcactctcttcaaggaaatccgtaatgttaaacccgacacgatgaagcttgtcgttggatggaaaggaaaagagttctacagggaaacttggacccgcttcatggaagacagcttccccattgttaacgaccaagaagtgatggatgttttccttgttgtcaacatgcgtcccactagacccaaccgttgttacaaattcctggcccaacacgctctgcgttgcgaccccgactatgtacctcatgacgtgattaggatcgtcgagccttcatgggtgggcagcaacaacgagtaccgcatcagcctggctaagaagggcggcggctgcccaataatgaaccttcactctgagtacaccaactcgttcgaacagttcatcgatcgtgtcatctgggagaacttctacaagcccatcgtttacatcggtaccgactctgctgaagaggaggaaattctccttgaagtttccctggtgttcaaagtaaaggagtttgcaccagacgcacctctgttcactggtccggcgtattaaaacacgatacattgttattagtacatttattaagcgctagattctgtgcgttgttgatttacagacaattgttgtacgtattttaataattcattaaatttataatctttagggtggtatgttagagcgaaaatcaaatgattttcagcgtctttatatctgaatttaaatattaaatcctcaatagatttgtaaaataggtttcgattagtttcaaacaagggttgtttttccgaaccgatggctggactatctaatggattttcgctcaacgccacaaaacttgccaaatcttgtagcagcaatctagctttgtcgatattcgtttgtgttttgttttgtaataaaggttcgacgtcgttcaaaatattatgcgcttttgtatttctttcatcactgtcgttagtgtacaattgactcgacgtaaacacgttaaataaagcttggacatatttaacatcgggcgtgttagctttattaggccgattatcgtcgtcgtcccaaccctcgtcgttagaagttgcttccgaagacgattttgccatagccacacgacgcctattaattgtgtcggctaacacgtccgcgatcaaatttgtagttgagctttttggaattatttctgattgcgggcgtttttgggcgggtttcaatctaactgtgcccgattttaattcagacaacacgttagaaagcgatggtgcaggcggtggtaacatttcagacggcaaatctactaatggcggcggtggtggagctgatgataaatctaccatcggtggaggcgcaggcggggctggcggcggaggcggaggcggaggtggtggcggtgatgcagacggcggtttaggctcaaatgtctctttaggcaacacagtcggcacctcaactattgtactggtttcgggcgccgtttttggtttgaccggtctgagacgagtgcgatttttttcgtttctaatagcttccaacaattgttgtctgtcgtctaaaggtgcagcgggttgaggttccgtcggcattggtggagcgggcggcaattcagacatcgatggtggtggtggtggtggaggcgctggaatgttaggcacgggagaaggtggtggcggcggtgccgccggtataatttgttctggtttagtttgttcgcgcacgattgtgggcaccggcgcaggcgccgctggctgcacaacggaaggtcgtctgcttcgaggcagcgcttggggtggtggcaattcaatattataattggaatacaaatcgtaaaaatctgctataagcattgtaatttcgctatcgtttaccgtgccgatatttaacaaccgctcaatgtaagcaattgtattgtaaagagattgtctcaagctccgcacgccgataacaagccttttcatttttactacagcattgtagtggcgagacacttcgctgtcgtcgacgtacatgtatgctttgttgtcaaaaacgtcgttggcaagctttaaaatatttaaaagaacatctctgttcagcaccactgtgttgtcgtaaatgttgtttttgataatttgcgcttccgcagtatcgacacgttcaaaaaattgatgcgcatcaattttgttgttcctattattgaataaataagattgtacagattcatatctacgattcgtcatggccaccacaaatgctacgctgcaaacgctggtacaattttacgaaaactgcaaaaacgtcaaaactcggtataaaataatcaacgggcgctttggcaaaatatctattttatcgcacaagcccactagcaaattgtatttgcagaaaacaatttcggcgcacaattttaacgctgacgaaataaaagttcaccagttaatgagcgaccacccaaattttataaaaatctattttaatcacggttccatcaacaaccaagtgatcgtgatggactacattgactgtcccgatttatttgaaacactacaaattaaaggcgagctttcgtaccaacttgttagcaatattattagacagctgtgtgaagcgctcaacgatttgcacaagcacaatttcatacacaacgacataaaactcgaaaatgtcttatatttcgaagcacttgatcgcgtgtatgtttgcgattacggattgtgcaaacacgaaaactcacttagcgtgcacgacggcacgttggagtattttagtccggaaaaaattcgacacacaactatgcacgtttcgtttgactggtacgcggcgtgttaacatacaagttgctaaccggcggttcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgcc

SEQ ID NO: 495 - protein, 8 aa, Artificial Sequence
  FLAG tag
DYKDDDDK

SEQ ID NO: 496 - protein, 6 aa, Artificial Sequence
  6xHis tag
HHHHHH

SEQ ID NO: 497 - protein, 432 aa, Homo sapiens
  Mutant AT3 sequence; AT3/RRVRKE
HGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVRRVRKENPNRVTFKANRPFLVFIREVPLNTIIFMGRVANPCVK

SEQ ID NO: 498 - protein, 6 aa, Artificial Sequence
  replacement cleavage site RRVRKE
RRVRKE

SEQ ID NO: 499 - protein, 432 aa, Homo sapiens
  Mutant AT3 sequence; AT3/SLGRKI
HGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVSLGRKINPNRVTFKANRPFLVFIREVPLNTIIFMGRVANPCVK

SEQ ID NO: 500 - protein, 432 aa, Homo sapiens
  Mutant AT3 sequence; SKGRSL
HGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVSKGRSLNPNRVTFKANRPFLVFIREVPLNTIIFMGRVANPCVK

SEQ ID NO: 501 - protein, 6 aa, Artificial Sequence
  replacement cleavage site SKGRSL
SKGRSL

SEQ ID NO: 502 - protein, 432 aa, Homo sapiens
  Mutant AT3 sequence; AT3/PRFKII
HGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVPRFKIINPNRVTFKANRPFLVFIREVPLNTIIFMGRVANPCVK

SEQ ID NO: 503 - protein, 6 aa, Artificial Sequence
  replacement cleavage site PRFKII
PRFKII

SEQ ID NO: 504 - DNA, 723 bp, Homo sapiens
  MT-SP1 protease domain
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 505 - protein, 241 aa, Homo sapiens [sequence omitted]

SEQ ID NO: 506 - protein, 444 aa, Homo sapiens [sequence omitted]

SEQ ID NO: 507 - protein, 241 aa, Homo sapiens [sequence omitted]

SEQ ID NO: 508 - DNA, 44 bp, Artificial Sequence
  MT-SP1 forward primer
gcgcagatatcgtaccgcatatgaaaaagaatatcgcatttctt

SEQ ID NO: 509 - DNA, 43 bp, Artificial Sequence
  MT-SP1 reverse  primer
gtgcatgctgactgactgagctcccgcttaccccagtgttctc

SEQ ID NO: 510 - DNA, 1335 bp, Homo sapiens
  MT-SP1 protease domain fusion; STII/MT-SP1/GeneIII
atgaaaaagaatatcgcatttcttcttgcatctatgttcgttttttctattgctacaaatgcctatgcagttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtaagcgggagctccggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttagcgctggtaaaccatatgaattttctattgattgtgacaaaataaacttattccgtggtgtctttgcgtttcttttatatgttgccacctttatgtatgtattttctacgtttgctaacatactgcgtaataaggagtcttaa

SEQ ID NO: 511 - protein, 23 aa, Escherichia coli
  STII leader sequence
MKKNIAFLLASMFVFSIATNAYA

SEQ ID NO: 512 - protein, 180 aa, M13 phage
  GeneIII
SGSSGGGSEGGGSEGGGSEGGGSGGGSGSGDFDYEKMANANKGAMTENADENALQSDAKGKLDSVATDYGAAIDGFIGDVSGLANGNGATGDFAGSNSQMAQVGDGDNSPLMNNFRQYLPSLPQSVECRPFVFSAGKPYEFSIDCDKINLFRGVFAFLLYVATFMYVFSTFANILRNKES

SEQ ID NO: 513 - protein, 4 aa, Artificial Sequence
  Synthesized protease cleavage site RQAR
RQAR

SEQ ID NO: 514 - protein, 4 aa, Artificial Sequence
  Synthesized protease cleavage site SLGR
SLGR

SEQ ID NO: 515 - protein, 855 aa, Homo sapiens
  Mutant MT-SP1 full length; CB469
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 516 - protein, 241 aa, Homo sapiens
  Mutant MTSP-1 protease domain; CPC-0019595
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKATWVTGWGHTQYGGTGALILQKGEIRVIDQATCENLLPQQITPRMMCVGLLSGGVDSCQGDSGGPLSSVEADGRIFQAGVVSWGVGCAQRNKPGVYTRLPLFRDWIKENTGV

SEQ ID NO: 517 - protein, 241 aa, Homo sapiens
  Mutant MT-SP1 protease domain; CPC-0023085
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 518 - protein, 241 aa, Homo sapiens
  Mutant MT-SP1 protease domain; CPC-0024153
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDTSHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGG

SEQ ID NO: 519 - protein, 241 aa, Homo sapiens
  Mutant MT-SP1 protease domain; CPC-0025366
VVGGTDAEEGEWPWQVSLHALGQGHFCGASLISPNWLVSAAHCYIDDRGFRYSDPTQWTAFLGLHDQSQRSAPGVQERRLKRIISHPFFNDFPFDYDIALLELEKPAEYSSMVRPISLPDASHVFPAGKAIWVTGWGHIQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 520 - protein, 241 aa, Homo sapiens; identical to SEQ ID NO: 517
  Mutant MT-SP1 protease domain; CPC-0025387

SEQ ID NO: 521 - protein, 241 aa, Homo sapiens
  Mutant MT-SP1 protease domain; CPC-0025582
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENFLPQQITPRMMCVGFLSGGVDSCQGDSGGPLSSVEADGRIFQAGVVSWGDGCAQRNKPGVYTRLPLFRDWIKENTGG

SEQ ID NO: 522 - protein, 241 aa, Homo sapiens
  Mutant MT-SP-1 protease domain; CPC-0025720
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGRTQYGGTGALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 523 - protein, 241 aa, Homo sapiens
  Mutant MT-SP1 protease domain; CPC-0025876
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENFLPQQITPRMMCVGFLSGGVDSCQGDSGGPLSSVEADGRIFQAGVVSWGDGCAQRNKPGVYTRLPLFRDWIKENTGV

SEQ ID NO: 524 - protein, 241 aa, Homo sapiens [sequence omitted]

SEQ ID NO: 525 - protein, 241 aa, Homo sapiens
  Mutant MT-SP1 protease domain; CPC-0026100
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALVLQKGEIRVINQTTCENLLPQQITPRMMCVGFLSGGVDSCQGDSGGPLSSVEADGRIFQAGVVSWGDGCAQRNKPGVYTRLPLFRDWIKENTGG

SEQ ID NO: 526 - protein, 241 aa, Homo sapiens
  Mutant MT-SP1 protease domain; CPC-0026323
VVGGTDADEGEWPWQVSLHALGQGHFCGASLISPNWMVSAAHCYIDDRGFRYSDPTQWTAFLGLHDQSQRSAPGVQERRLKRIISHPFFNDFTFDYDIALLELEKPAEYSSMVRPISLPDASHDFPAGKAIWVTGWGHTQYGGTGALILQKGEIRVINQTTCENLLPQQITPRMMCVGFLSGGVDSCQGDSGGPLSSVEADGRIFQAGVVSWGDGCALRNKPGVYTRLPLFRDWIKENTGV

SEQ ID NO: 527 - protein, 241 aa, Homo sapiens
  Mutant MT-SP1 protease domain; CPC-0027399
VVGGTDADEGEWPWQVSLHALGQGHICGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 528 - protein, 241 aa, Homo sapiens
  Mutant MT-SP1 protease domain; CPC-0027706
VVGGTDADEGEWPWQVSLHALGQGHICGASLISPNWLVSAAHCYIDDRGFRYSDPTQWTAFLGLHDQSQRSAPGVQERRLKRIISHPFFNDYTFDYDIALLELEKPAEYSSMVRPISLPDASHVFPAGKAVWVTGWGHTQYGGTGALILQKGEIRVINQTTCENLLPQQITPRMMCVGFLSGGVDSCHGDSGGPLSIVEADGRIFQAGVVSWGDGCAQRNKPGVYTRLPLFRDWIKENTGV

SEQ ID NO: 529 - protein, 241 aa, Homo sapiens
  Mutant MT-SP1 protease domain; CPC-0027797
VVGGTDADEGEWPWQVSLHALGQGHICGASLISPNWLVSAAHCYIDDRGFRYSDPTQWTAFLGLRDQSQRSAPGVQERRLKRIISHPFFNDFTFDYDIALLELEKPAEYSSMVRPISLPDASHVFSAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 530 - protein, 241 aa, Homo sapiens
  Mutant MT-SP1 protease domain; CPC-0028017
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 531 - protein, 241 aa, Homo sapiens
  Mutant MT-SP1 protease domain; CPC-0028333
VVGGTDADEGEWPWQVSLHALGQGHICGASLISPNWLVSAAHCYIDDRGFRYSDPTQWKAFLGLHDQSQRSAPGVQERRLKRIISHPLFNDYTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 532 - protein, 241 aa, Homo sapiens
  Mutant MT-SP1 protease domain; CPC-0028341
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLSQQITPRMMCVGFLSGGVDSCQGDSGGPLSSVEADGRIFLAGVVSWGDGCAQRNKPGVYTRLPLFRDWIKENTGV

SEQ ID NO: 533 - protein, 241 aa, Homo sapiens
  Mutant MT-SP1 protease domain; CPC-0033634
VVGGTDADEGEWPWQVSLHALGQGHICGASLISPNWLVSAAHCYIDDRGFRYSDPTQWTAFLGLHDQSQRSAPGVQERRLKRIISHPLFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLLRDWIKENTGV

SEQ ID NO: 534 - protein, 241 aa, Homo sapiens [sequence omitted]

SEQ ID NO: 535 - protein, 241 aa, Homo sapiens
  Mutant MT-SP1 protease domain; CPC-0027484
VVGGTDADEGEWPWQVSLHALGQGHICGASLISPNWLVSAAHCYIDDRGFRYSDPTQWTAFLGLHDQSQRSAPGVQERRLKRIISHPFFKDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 536 - protein, 241 aa, Homo sapiens
  Mutant MT-SP1 protease domain; CPC-0028993
VVGGTDADEGEWPWQVSLHALGQGHICGASLISPNWLVSAAHCYIDDRGFRSSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 537 - protein, 855 aa, Homo sapiens
  Mutant MT-SP1 full length; CPC-0019595
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKATWVTGWGHTQYGGTGALILQKGEIRVIDQATCENLLPQQITPRMMCVGLLSGGVDSCQGDSGGPLSSVEADGRIFQAGVVSWGVGCAQRNKPGVYTRLPLFRDWIKENTGV

SEQ ID NO: 538 - protein, 855 aa, Homo sapiens
  Mutant MT-SP1 full length; CPC-0023085
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 539 - protein, 855 aa, Homo sapiens
  Mutant MT-SP1 full length; CPC-0024153
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDTSHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGG

SEQ ID NO: 540 - protein, 855 aa, Homo sapiens
  Mutant MT-SP1 full length; CPC-0025366
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDAEEGEWPWQVSLHALGQGHFCGASLISPNWLVSAAHCYIDDRGFRYSDPTQWTAFLGLHDQSQRSAPGVQERRLKRIISHPFFNDFPFDYDIALLELEKPAEYSSMVRPISLPDASHVFPAGKAIWVTGWGHIQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 541 - protein, 855 aa, Homo sapiens; identical to SEQ ID NO: 538
  Mutant MT-SP1 full length; CPC-0025387

SEQ ID NO: 542 - protein, 855 aa, Homo sapiens
  Mutant MT-SP1 full length; CPC-0025582
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENFLPQQITPRMMCVGFLSGGVDSCQGDSGGPLSSVEADGRIFQAGVVSWGDGCAQRNKPGVYTRLPLFRDWIKENTGG

SEQ ID NO: 543 - protein, 855 aa, Homo sapiens
  Mutant MT-SP1 full length; CPC-0025720
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGRTQYGGTGALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 544 - protein, 855 aa, Homo sapiens
  Mutant MT-SP1 full length; CPC-0025876
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENFLPQQITPRMMCVGFLSGGVDSCQGDSGGPLSSVEADGRIFQAGVVSWGDGCAQRNKPGVYTRLPLFRDWIKENTGV

SEQ ID NO: 545 - protein, 855 aa, Homo sapiens; identical to SEQ ID NO: 515
  Mutant MT-SP1 full length; CPC-0025974

SEQ ID NO: 546 - protein, 855 aa, Homo sapiens
  Mutant MT-SP1 full length; CPC-0026100
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALVLQKGEIRVINQTTCENLLPQQITPRMMCVGFLSGGVDSCQGDSGGPLSSVEADGRIFQAGVVSWGDGCAQRNKPGVYTRLPLFRDWIKENTGG

SEQ ID NO: 547 - protein, 855 aa, Homo sapiens
  Mutant MT-SP1 full length; CPC-0026323
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWMVSAAHCYIDDRGFRYSDPTQWTAFLGLHDQSQRSAPGVQERRLKRIISHPFFNDFTFDYDIALLELEKPAEYSSMVRPISLPDASHDFPAGKAIWVTGWGHTQYGGTGALILQKGEIRVINQTTCENLLPQQITPRMMCVGFLSGGVDSCQGDSGGPLSSVEADGRIFQAGVVSWGDGCALRNKPGVYTRLPLFRDWIKENTGV

SEQ ID NO: 548 - protein, 855 aa, Homo sapiens
  Mutant MT-SP1 full length; CPC-002739
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 549 - protein, 855 aa, Homo sapiens
  Mutant MT-SP1 full length; CPC-0027706
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDYTFDYDIALLELEKPAEYSSMVRPISLPDASHVFPAGKAVWVTGWGHTQYGGTGALILQKGEIRVINQTTCENLLPQQITPRMMCVGFLSGGVDSCHGDSGGPLSIVEADGRIFQAGVVSWGDGCAQRNKPGVYTRLPLFRDWIKENTGV

SEQ ID NO: 550 - protein, 855 aa, Homo sapiens
  Mutant MT-SP1 full length; CPC-0027797
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLRDQSQRSAPGVQERRLKRIISHPFFNDFTFDYDIALLELEKPAEYSSMVRPISLPDASHVFSAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 551 - protein, 855 aa, Homo sapiens
  Mutant MT-SP1 full length; CPC-0028017
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 552 - protein, 855 aa, Homo sapiens
  Mutant MT-SP1 full length; CPC-0028333
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWKAFLGLHDQSQRSAPGVQERRLKRIISHPLFNDYTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 553 - protein, 855 aa, Homo sapiens
  Mutant MT-SP1 full length; CPC-0028341
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLSQQITPRMMCVGFLSGGVDSCQGDSGGPLSSVEADGRIFLAGVVSWGDGCAQRNKPGVYTRLPLFRDWIKENTGV

SEQ ID NO: 554 - protein, 855 aa, Homo sapiens
  Mutant MT-SP1 full length; CPC-0033634
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPLFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLLRDWIKENTGV

SEQ ID NO: 555 - protein, 855 aa, Homo sapiens; identical to SEQ ID NO: 515
  Mutant MT-SP1 full length; CPC-0028791

SEQ ID NO: 556 - protein, 855 aa, Homo sapiens
  Mutant MT-SP1 full length; CPC-0027484
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFKDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 557 - protein, 855 aa, Homo sapiens
  Mutant MT-SP1 full length; CPC-0028993
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRSSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 558 - protein, 26 aa, Artificial Sequence
  N-terminal sequence of pIVEX 2.3d MTSP
MEKTRHHHHHHSGSDCGLRSFTRQAR

SEQ ID NO: 559 - DNA, 3560 bp, Artificial Sequence
  pIVEX 2.3d vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagaaataattttgtttaactttaagaaggagatataccatggcacatatgagcggccgcgtcgactcgagcgagctcccggggggggttctcatcatcatcatcatcattaataaaagggcgaattccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 560 - DNA, 36 bp, Artificial Sequence
  pQE-Insert-F2 forward primer
ttcacgagacaggctcgtgttgttgggggcacggat

SEQ ID NO: 561 - DNA, 37 bp, Artificial Sequence
  pQE-Insert-R3 reverse primer
cagctaattaagcttattataccccagtgttctcttt

SEQ ID NO: 562 - DNA, 30 bp, Artificial Sequence
  pQE-Linear-F2 primer
acgagcctgtctcgtgaatgaccgcagccc

SEQ ID NO: 563 - DNA, 31 bp, Artificial Sequence
  pQE-Linear-R1 primer
taataagcttaattagctgagcttggactcc

SEQ ID NO: 564 - DNA, 19 bp, Artificial Sequence
  forward primer: MTSP-5F
ggagaaaccggcagagtac

SEQ ID NO: 565 - DNA, 19 bp, Artificial Sequence
  reverse primer MTSP-5R
ggttctcgcaggtggtctg

SEQ ID NO: 566 - DNA, 5443 bp, Artificial Sequence
  pET21a vector
atccggatatagttcctcctttcagcaaaaaacccctcaagacccgtttagaggccccaaggggttatgctagttattgctcagcggtggcagcagccaactcagcttcctttcgggctttgttagcagccggatctcagtggtggtggtggtggtgctcgagtgcggccgcaagcttgtcgacggagctcgaattcggatccgcgacccatttgctgtccaccagtcatgctagccatatgtatatctccttcttaaagttaaacaaaattatttctagaggggaattgttatccgctcacaattcccctatagtgagtcgtattaatttcgcgggatcgagatctcgatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgagatcccggacaccatcgaatggcgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagctcactcattaggcaccgggatctcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgcca

SEQ ID NO: 567 - protein, 379 aa, Homo sapiens
  PAI-1 stable
VHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISHLLGTGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVALALQKVKIEVNESGTVASSSTAVIVSARMAPEEIIIDRPFLFVVRHNPTGTVLFMGQVMEP

SEQ ID NO: 568 - protein, 241 aa, Homo sapiens
  Mutant MTSP1 protease domain; I136T/N164D/T166A/F184(A)L/D217V
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKATWVTGWGHTQYGGTGALILQKGEIRVIDQATCENLLPQQITPRMMCVGLLSGGVDSCQGDSGGPLSSVEADGRIFQAGVVSWGVGCAQRNKPGVYTRLPLFRDWIKENTGV

SEQ ID NO: 569 - protein, 241 aa, Homo sapiens
  Mutant MTSP1 protease domain; I41F
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 570 - protein, 241 aa, Homo sapiens
  Mutant MTSP1 protease domain; I41F/A126T/V244G
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDTSHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGG

SEQ ID NO: 571 - protein, 241 aa, Homo sapiens
  Mutant MTSP1 protease domain; D23E/I41F/T98P/T144I
VVGGTDAEEGEWPWQVSLHALGQGHFCGASLISPNWLVSAAHCYIDDRGFRYSDPTQWTAFLGLHDQSQRSAPGVQERRLKRIISHPFFNDFPFDYDIALLELEKPAEYSSMVRPICLPDASHVFPAGKAIWVTGWGHIQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 572 - protein, 241 aa, Homo sapiens; identical to SEQ ID NO: 569
  Mutant MTSP1 protease domain; I41F

SEQ ID NO: 573 - protein, 241 aa, Homo sapiens
  Mutant MTSP1 protease domain; I41F/L171F/V244G
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENFLPQQITPRMMCVGFLSGGVDSCQGDSGGPLSSVEADGRIFQAGVVSWGDGCAQRNKPGVYTRLPLFRDWIKENTGG

SEQ ID NO: 574 - protein, 241 aa, Homo sapiens
  Mutant MTSP1 protease domain; H143R/Q175R
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGRTQYGGTGALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 575 - protein, 241 aa, Homo sapiens
  Mutant MTSP1 protease domain; I41F/L171F
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENFLPQQITPRMMCVGFLSGGVDSCQGDSGGPLSSVEADGRIFQAGVVSWGDGCAQRNKPGVYTRLPLFRDWIKENTGV

SEQ ID NO: 576 - protein, 241 aa, Homo sapiens [sequence omitted]

SEQ ID NO: 577 - protein, 241 aa, Homo sapiens
  Mutant MTSP1 protease domain; I41F/I154V/V244G
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALVLQKGEIRVINQTTCENLLPQQITPRMMCVGFLSGGVDSCQGDSGGPLSSVEADGRIFQAGVVSWGDGCAQRNKPGVYTRLPLFRDWIKENTGG

SEQ ID NO: 578 - protein, 241 aa, Homo sapiens
  Mutant MTSP1 protease domain; I141F/L52M/V129D/Q221(A)L
VVGGTDADEGEWPWQVSLHALGQGHFCGASLISPNWMVSAAHCYIDDRGFRYSDPTQWTAFLGLHDQSQRSAPGVQERRLKRIISHPFFNDFTFDYDIALLELEKPAEYSSMVRPICLPDASHDFPAGKAIWVTGWGHTQYGGTGALILQKGEIRVINQTTCENLLPQQITPRMMCVGFLSGGVDSCQGDSGGPLSSVEADGRIFQAGVVSWGDGCALRNKPGVYTRLPLFRDWIKENTGV

SEQ ID NO: 579 - protein, 241 aa, Homo sapiens
  Mutant MTSP1 protease domain; F99L
VVGGTDADEGEWPWQVSLHALGQGHICGASLISPNWLVSAAHCYIDDRGFRYSDPTQWTAFLGLHDQSQRSAPGVQERRLKRIISHPFFNDFTLDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 580 - protein, 241 aa, Homo sapiens
  Mutant MTSP1 protease domain; F97Y/I136V/Q192H/S201I
VVGGTDADEGEWPWQVSLHALGQGHICGASLISPNWLVSAAHCYIDDRGFRYSDPTQWTAFLGLHDQSQRSAPGVQERRLKRIISHPFFNDYTFDYDIALLELEKPAEYSSMVRPICLPDASHVFPAGKAVWVTGWGHTQYGGTGALILQKGEIRVINQTTCENLLPQQITPRMMCVGFLSGGVDSCHGDSGGPLSIVEADGRIFQAGVVSWGDGCAQRNKPGVYTRLPLFRDWIKENTGV

SEQ ID NO: 581 - protein, 241 aa, Homo sapiens
  Mutant MTSP1 protease domain; H71R/P131S/D217V
VVGGTDADEGEWPWQVSLHALGQGHICGASLISPNWLVSAAHCYIDDRGFRYSDPTQWTAFLGLRDQSQRSAPGVQERRLKRIISHPFFNDFTFDYDIALLELEKPAEYSSMVRPICLPDASHVFSAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 582 - protein, 241 aa, Homo sapiens
  Mutant MTSP1 protease domain; D217V
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 583 - protein, 241 aa, Homo sapiens
  Mutant MTSP1 protease domain; T65K/F93L/F97Y/D217V
VVGGTDADEGEWPWQVSLHALGQGHICGASLISPNWLVSAAHCYIDDRGFRYSDPTQWKAFLGLHDQSQRSAPGVQERRLKRIISHPLFNDYTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 584 - protein, 241 aa, Homo sapiens
  Mutant MTSP1 protease domain; I41T/P173S/Q209L
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLSQQITPRMMCVGFLSGGVDSCQGDSGGPLSSVEADGRIFLAGVVSWGDGCAQRNKPGVYTRLPLFRDWIKENTGV

SEQ ID NO: 585 - protein, 241 aa, Homo sapiens
  Mutant MTSP1 protease domain; F97L//F234L
VVGGTDADEGEWPWQVSLHALGQGHICGASLISPNWLVSAAHCYIDDRGFRYSDPTQWTAFLGLHDQSQRSAPGVQERRLKRIISHPLFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLLRDWIKENTGV

SEQ ID NO: 586 - protein, 241 aa, Homo sapiens [sequence omitted]

SEQ ID NO: 587 - protein, 241 aa, Homo sapiens
  Mutant MTSP1 protease domain; N95K
VVGGTDADEGEWPWQVSLHALGQGHICGASLISPNWLVSAAHCYIDDRGFRYSDPTQWTAFLGLHDQSQRSAPGVQERRLKRIISHPFFKDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 588 - protein, 241 aa, Homo sapiens
  Mutant MTSP1 protease domain; Y60(G)S
VVGGTDADEGEWPWQVSLHALGQGHICGASLISPNWLVSAAHCYIDDRGFRSSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 589 - protein, 855 aa, Homo sapiens
  Mutant MTSP1 full length; I136T/N164D/T166A/F184(A)L/D217V
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKATWVTGWGHTQYGGTGALILQKGEIRVIDQATCENLLPQQITPRMMCVGLLSGGVDSCQGDSGGPLSSVEADGRIFQAGVVSWGVGCAQRNKPGVYTRLPLFRDWIKENTGV

SEQ ID NO: 590 - protein, 855 aa, Homo sapiens
  Mutant MTSP1 full length; I41F
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 591 - protein, 855 aa, Homo sapiens
  Mutant MTSP1 full length; I41F/A126T/V244G
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDTSHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGG

SEQ ID NO: 592 - protein, 855 aa, Homo sapiens
  Mutant MTSP1 full length; D23E/I41F/T98P/T144I
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDAEEGEWPWQVSLHALGQGHFCGASLISPNWLVSAAHCYIDDRGFRYSDPTQWTAFLGLHDQSQRSAPGVQERRLKRIISHPFFNDFPFDYDIALLELEKPAEYSSMVRPICLPDASHVFPAGKAIWVTGWGHIQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 593 - protein, 855 aa, Homo sapiens; identical to SEQ ID NO: 590
  Mutant MTSP1 full length; I41F

SEQ ID NO: 594 - protein, 855 aa, Homo sapiens
  Mutant MTSP1 full length; I41F/L171F/V244G
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENFLPQQITPRMMCVGFLSGGVDSCQGDSGGPLSSVEADGRIFQAGVVSWGDGCAQRNKPGVYTRLPLFRDWIKENTGG

SEQ ID NO: 595 - protein, 855 aa, Homo sapiens
  Mutant MTSP1 full length; H143R/Q175R
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGRTQYGGTGALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 596 - protein, 855 aa, Homo sapiens
  Mutant MTSP1 full length; I41F/L171F
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENFLPQQITPRMMCVGFLSGGVDSCQGDSGGPLSSVEADGRIFQAGVVSWGDGCAQRNKPGVYTRLPLFRDWIKENTGV

SEQ ID NO: 597 - protein, 855 aa, Homo sapiens [sequence omitted]

SEQ ID NO: 598 - protein, 855 aa, Homo sapiens
  Mutant MTSP1 full length; I41F/I154V/V244G
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALVLQKGEIRVINQTTCENLLPQQITPRMMCVGFLSGGVDSCQGDSGGPLSSVEADGRIFQAGVVSWGDGCAQRNKPGVYTRLPLFRDWIKENTGG

SEQ ID NO: 599 - protein, 855 aa, Homo sapiens
  Mutant MTSP1 full length; I141F/L52M/V129D/Q221(A)L
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWMVSAAHCYIDDRGFRYSDPTQWTAFLGLHDQSQRSAPGVQERRLKRIISHPFFNDFTFDYDIALLELEKPAEYSSMVRPICLPDASHDFPAGKAIWVTGWGHTQYGGTGALILQKGEIRVINQTTCENLLPQQITPRMMCVGFLSGGVDSCQGDSGGPLSSVEADGRIFQAGVVSWGDGCALRNKPGVYTRLPLFRDWIKENTGV

SEQ ID NO: 600 - protein, 855 aa, Homo sapiens
  Mutant MTSP1 full length; F99L
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTLDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 601 - protein, 855 aa, Homo sapiens
  Mutant MTSP1 full length; F97Y/I136V/Q192H/S201I
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDYTFDYDIALLELEKPAEYSSMVRPICLPDASHVFPAGKAVWVTGWGHTQYGGTGALILQKGEIRVINQTTCENLLPQQITPRMMCVGFLSGGVDSCHGDSGGPLSIVEADGRIFQAGVVSWGDGCAQRNKPGVYTRLPLFRDWIKENTGV

SEQ ID NO: 602 - protein, 855 aa, Homo sapiens
  Mutant MTSP1 full length; H71R/P131S/D217V
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLRDQSQRSAPGVQERRLKRIISHPFFNDFTFDYDIALLELEKPAEYSSMVRPICLPDASHVFSAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 603 - protein, 855 aa, Homo sapiens
  Mutant MTSP1 full length; D217V
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 604 - protein, 855 aa, Homo sapiens
  Mutant MTSP1 full length; T65K/F93L/F97Y/D217V
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWKAFLGLHDQSQRSAPGVQERRLKRIISHPLFNDYTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 605 - protein, 855 aa, Homo sapiens
  Mutant MTSP1 full length; I41T/P173S/Q209L
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLSQQITPRMMCVGFLSGGVDSCQGDSGGPLSSVEADGRIFLAGVVSWGDGCAQRNKPGVYTRLPLFRDWIKENTGV

SEQ ID NO: 606 - protein, 855 aa, Homo sapiens
  Mutant MTSP1 full length; F97L//F234L
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPLFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLLRDWIKENTGV

SEQ ID NO: 607 - protein, 855 aa, Homo sapiens [sequence omitted]

SEQ ID NO: 608 - protein, 855 aa, Homo sapiens
  Mutant MTSP1 full length; N95K
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFKDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 609 - protein, 855 aa, Homo sapiens
  Mutant MTSP1 full length; Y60(G)S
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRSSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 610 - protein, 380 aa, Homo sapiens
  Mutant mature PAI-1; PAI-1/RRAR
MVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIRRARMAPEEIIMDRPFLFVVRHNPTGTVLFMGQVMEP

SEQ ID NO: 611 - protein, 380 aa, Homo sapiens
  Mutant mature PAI-1; PAI-1/69 (containing PFGRS)
MVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIPFGRSAPEEIIMDRPFLFVVRHNPTGTVLFMGQVMEP

SEQ ID NO: 612 - DNA, 1395 bp, Homo sapiens
  ATIII
atgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaa

SEQ ID NO: 613 - DNA, 1458 bp, Artificial Sequence
  AT3 His tag fusion protein
atgctactagtaaatcagtcacaccaaggcttcaataaggaacacacaagcaagatggtaagcgctattgttttatatgtgcttttggcggcggcggcgcattctgcctttgcggcggatcttggatcccacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtagagaaggaactcaccccagaggtgctgcaagagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagggaggcggaagccatcaccaccatcaccactaa

SEQ ID NO: 614 - protein, 485 aa, Artificial Sequence
  AT3 His tag fusion protein
MLLVNQSHQGFNKEHTSKMVSAIVLYVLLAAAAHSAFAADLGSHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVKGGGSHHHHHH

SEQ ID NO: 615 - DNA, 6644 bp, Artificial Sequence
  pMal2c vector
ccgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagctcactcattaggcacaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagccagtccgtttaggtgttttcacgagcacttcaccaacaaggaccatagattatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccaccatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatttcagaattcggatcctctagagtcgacctgcaggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcagcttggctgttttggcggatgagataagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttctccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgaaatt

SEQ ID NO: 616 - DNA, 543 bp, M13 phage
  GeneIII
agcggctcgagcggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcgctggtaaaccgtatgaattttctattgattgtgacaaaataaacttattccgtggtgtctttgcgtttcttttatatgttgccacctttatgtatgtattttctacgtttgctaacatactgcgtaataaggagtcttaa

SEQ ID NO: 617 - protein, 3 aa, Artificial Sequence
  uPA cleavage substrate AGR
AGR

SEQ ID NO: 618 - DNA, 20 bp, Artificial Sequence
  MTSP sequencing primer
ggtgttttcacgagcacttc

SEQ ID NO: 619 - DNA, 6601 bp, Artificial Sequence
  pCAT0002 vector
gatctcgatcccgcgaaattaatacgactcactataggggaattgtgagcggataacaattcccctctagaaataattttgtttaactttaagaaggagatatacatatgtcgggattaaacgacattttcgaagcgcagaagattgaatggcacgaggcgagcgaaaacttgtactttcagggcgtgcatcatccgccgagctatgtagcgcatctggcttccgactttggcgtgcgtgtgtttcagcaggtcgcccaggcgtcaaaagatcgcaatgtggtgttcagcccgtatggtgttgcgtccgtgttggcgatgcttcaacttactaccggcggtgaaacgcagcaacagattcaggcggcgatgggcttcaagatagatgacaaaggcatggcacccgccctgcgtcatctgtataaagaactgatggggccgtggaacaaagatgagattagcaccaccgatgcgatatttgtgcagcgcgatctgaagctggtccagggattcatgcctcatttcttccgtctgtttcgtagcaccgtgaaacaggtggattttagcgaggtggagcgtgcccgcttcatcataaacgattgggtgaagacccacacgaagggcatgatttcgcacctgcttgggaccggcgctgtggatcaactgacccgtctggtgctggtaaatgcgttgtatttcaacgggcaatggaaaaccccgtttccggattcaagcacccatcgtcgtctttttcataaaagcgatggctctaccgtcagcgtccccatgatggcgcagacgaacaaattcaattacaccgaattcaccacgccggatggccactactatgatattctggagctgccgtaccatggcgataccctgagcatgttcattgcggcaccgtatgagaaagaagtgccgctgtcggctctgaccaacattctgagcgcgcagcttattagccattggaaaggcaatatgacccgcctgccacgtctgctggttctgccgaaatttagcctggagaccgaagtggatctgcgtaaaccgctggagaatctggggatgacggatatgttccggcagtttcaagctgatttcaccagccttagcgaccaggaacctctgcatgtggccctggcgttgcagaaggttaagatcgaagtgaatgaaagcggaaccgtggcgtctagtagcactgctgtgattcgtcgtgcgcgtatggcgcctgaggaaattatcatcgaccgtccgttcctgtttgtggtgcgtcacaatccgaccgggactgtgctgtttatgggccaggtgatggaaccgtaataagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcga

SEQ ID NO: 620 - protein, 4 aa, Artificial Sequence
  GGGS linker
GGGS

SEQ ID NO: 621 - protein, 405 aa, Homo sapiens
  Mutant PAI-1; OptiPAI-1stab
MSGLNDIFEAQKIEWHEASENLYFQGVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISHLLGTGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVALALQKVKIEVNESGTVASSSTAVIRRARMAPEEIIIDRPFLFVVRHNPTGTVLFMGQVMEP

SEQ ID NO: 622 - protein, 381 aa, Homo sapiens
  Mutant PAI-1; V1C OptiPAI-1stab
MCVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISHLLGTGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVALALQKVKIEVNESGTVASSSTAVIRRARMAPEEIIIDRPFLFVVRHNPTGTVLFMGQVMEP

SEQ ID NO: 623 - DNA, 6526 bp, Artificial Sequence
  pCAT0051 vector
gatctcgatcccgcgaaattaatacgactcactataggggaattgtgagcggataacaattcccctctagaaataattttgtttaactttaagaaggagatatacatatgtgccatcatccgccgagctatgtagcgcatctggcttccgactttggcgtgcgtgtgtttcagcaggtcgcccaggcgtcaaaagatcgcaatgtggtgttcagcccgtatggtgttgcgtccgtgttggcgatgcttcaacttactaccggcggtgaaacgcagcaacagattcaggcggcgatgggcttcaagatagatgacaaaggcatggcacccgccctgcgtcatctgtataaagaactgatggggccgtggaacaaagatgagattagcaccaccgatgcgatatttgtgcagcgcgatctgaagctggtccagggattcatgcctcatttcttccgtctgtttcgtagcaccgtgaaacaggtggattttagcgaggtggagcgtgcccgcttcatcataaacgattgggtgaagacccacacgaagggcatgatttcgcacctgcttgggaccggcgctgtggatcaactgacccgtctggtgctggtaaatgcgttgtatttcaacgggcaatggaaaaccccgtttccggattcaagcacccatcgtcgtctttttcataaaagcgatggctctaccgtcagcgtccccatgatggcgcagacgaacaaattcaattacaccgaattcaccacgccggatggccactactatgatattctggagctgccgtaccatggcgataccctgagcatgttcattgcggcaccgtatgagaaagaagtgccgctgtcggctctgaccaacattctgagcgcgcagcttattagccattggaaaggcaatatgacccgcctgccacgtctgctggttctgccgaaatttagcctggagaccgaagtggatctgcgtaaaccgctggagaatctggggatgacggatatgttccggcagtttcaagctgatttcaccagccttagcgaccaggaacctctgcatgtggccctggcgttgcagaaggttaagatcgaagtgaatgaaagcggaaccgtggcgtctagtagcactgctgtgattcgtcgtgcgcgtatggcgcctgaggaaattatcatcgaccgtccgttcctgtttgtggtgcgtcacaatccgaccgggactgtgctgtttatgggccaggtgatggaaccgtaataagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcga

SEQ ID NO: 624 - DNA, 4202 bp, Artificial Sequence
  pQE30 vector
ctcgagaaatcataaaaaatttatttgctttgtgagcggataacaattataatagattcaattgtgagcggataacaatttcacacagaattcattaaagaggagaaattaactatgagaggatcgcatcaccatcaccatcacggatccgatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtatagaagcttaattagctgagcttggactcctgttgatagatccagtaatgacctcagaactccatctggatttgttcagaacgctcggttgccgccgggcgttttttattggtgagaatccaagctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggggtaatgactctctagcttgaggcatcaaataaaacgaaaggctcagtcgaaagactgggcctttcgttttatctgttgtttgtcggtgaacgctctcctgagtaggacaaatccgccctctagagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcac

SEQ ID NO: 625 - DNA, 4822 bp, Artificial Sequence
  pPAI-his vector
  misc_feature (1)...(4822): n = A,T,C or G
gatctcgatcccgcgaaattaatacgactcactatagggagaccacaacggtttccctctagaaataattttgtttaactttaagaaggagatatacatatgcaccatcaccatcaccatgctagcgagaatctttattttcagggcgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatannnnnnnnnnnnnnnnnncccgaggagatcatcatggacagacccttcctctttgtggtccggcacaaccccacaggaacagtccttttcatgggccaagtgatggaaccctgaaagcttccgggatccggctgctaacaaagcccgaaaggaagctgagttggctgctgccaccgctgagcaataactagcataaccccttggggcctctaaacgggtcttgaggggttttttgctgaaaggaggaactatatccggatcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaatt

SEQ ID NO: 626 - DNA, 42 bp, Artificial Sequence
  ATIII cDNA forward primer
gtcactgactgacgtggatcccacgggagccctgtggacatc

SEQ ID NO: 627 - protein, 9 aa, Artificial Sequence
  ATIII cDNA forward primer - encoded protein
GSHGSPVDI

SEQ ID NO: 628 - DNA, 60 bp, Artificial Sequence
  ATIII cDNA reverse primer
gtagccaacccttgtgttaagggaggcggaagccatcaccaccatcaccactaagaattc

SEQ ID NO: 629 - protein, 17 aa, Artificial Sequence
  ATIII cDNA reverse primer - encoded protein
VANPCVKGGGSHHHHHH

SEQ ID NO: 630 - DNA, 60 bp, Artificial Sequence
  Wild type AT3 primer
gctgcaagtaccgctgttgtgattgctggccgttcgctaaaccccaacagggtgactttc

SEQ ID NO: 631 - protein, 20 aa, Artificial Sequence
  Wild type AT3 primer - encoded protein
AASTAVVIAGRSLNPNRVTF

SEQ ID NO: 632 - DNA, 60 bp, Artificial Sequence
  Complement C2 Target Sequence primer
gctgcaagtaccgctgttgtgtcgttaggccgtaaaattaaccccaacagggtgactttc

SEQ ID NO: 633 - protein, 20 aa, Artificial Sequence
  Complement C2 Target Sequence primer - encoded protein
AASTAVVSLGRKINPNRVTF

SEQ ID NO: 634 - DNA, 60 bp, Artificial Sequence
  VEGFR2 Target Sequence primer
gctgcaagtaccgctgttgtgcgccgtgtgcgcaaagaaaaccccaacagggtgactttc

SEQ ID NO: 635 - protein, 20 aa, Artificial Sequence
  VEGFR2 Target Sequence primer - encoded primer
AASTAVVRRVRKENPNRVTF

SEQ ID NO: 636 - DNA, 68 bp, Escherichia coli
  STII leader
tgaaaaagaatatcgcatttcttcttgcatctatgttcgttttttctattgctacaaacgcgtatgca

SEQ ID NO: 637 - protein, 6 aa, Artificial Sequence
  MT-SP1 substrate recognition site
RQARVV

SEQ ID NO: 638 - protein, 4 aa, Artificial Sequence
  MT-SP1 cleavage sequence
VVGG

SEQ ID NO: 639 - protein, 4 aa, Artificial Sequence
  p35 cleavage site
DQMD

SEQ ID NO: 640 - protein, 4 aa, Artificial Sequence
  p49 caspase recognition sequence
TVTD

SEQ ID NO: 641 - protein, 4 aa, Artificial Sequence
  serine protease conserved region
IIGG

SEQ ID NO: 642 - protein, 4 aa, Artificial Sequence
  serine protease conserved region
VVGG

SEQ ID NO: 643 - protein, 4 aa, Artificial Sequence
  serine protease conserved region
IVGG

SEQ ID NO: 644 - protein, 4 aa, Artificial Sequence
  MT-SP1 substrate cleavage residue
KRSR

SEQ ID NO: 645 - protein, 4 aa, Artificial Sequence
  PAR-2 cleavage residue
SKGR

The invention claimed is:

1. A method for identifying or selecting a protease or catalytically active portion thereof that cleaves a cleavage sequence in a protein target substrate, comprising:
   a) contacting a collection comprising a plurality of different mutant proteases and/or catalytically active portions thereof that comprise the mutations(s) with a protease trap polypeptide, wherein:
   the protease trap polypeptide is a serpin or modified serpin, an alpha macroglobulin or a modified member of the alpha macroglobulin family, or, a p35 protein or a modified member of the p35 family;
   the protease trap polypeptide comprises a reactive site containing a cleavage sequence for the protein target substrate, or is modified in its reactive site by replacement of one or more of amino acids in the P4-P2' positions of the protease trap polypeptide to include the cleavage sequence of the protein target substrate;
   contacting is effected under conditions for cleavage of amino acids in the cleavage sequence in the protease trap polypeptide by a protease or a catalytically active portion thereof in the collection to form stable complexes containing the protease trap polypeptide covalently linked to a protease or catalytically active portion thereof;
   upon cleavage of amino acids in the cleavage sequence in the protease trap polypeptide by a protease or catalytically active portion thereof in the collection, the protease trap polypeptide forms a a stable complex with a protease or catalytically active portion thereof in the collection;
   b) separating the complexed proteases from uncomplexed members of the collection; and
   c) identifying or selecting the protease or catalytically active portion thereof in the complex, thereby identifying or selecting a protease or catalytically active portion thereof that cleaves the protein target substrate.

2. The method of claim 1, wherein the mutant proteases that are members of the collection comprise one or more of amino acid replacements, deletions or insertions in the primary sequence of an unmodified protease.

3. The method of claim 1, wherein:
   the protease trap polypeptide is labeled for detection or separation; and
   separation is effected by capture of complexes containing the detectable protease trap polypeptide with a protease or catalytically active portion thereof.

4. The method of claim 3, wherein the protease trap polypeptide is labeled with biotin.

5. The method of claim 3, wherein:
   the protease trap is labeled with a His tag; and
   separation is effected by capture with a metal chelating agent.

6. The method of claim 5, wherein the metal chelating agent is selected from nickel sulphate ($NiSO_4$), cobalt chloride ($CoCl_2$), copper sulphate ($CuSO_4$) or zinc chloride ($ZnCl_2$).

7. The method of claim 1, wherein the method is multiplexed, and wherein:
   a plurality of different protease trap polypeptides are contacted with the collection; and at least two protease trap polypeptides can be identifiably detected, whereby more than one protease or catalytically active portion thereof are identified.

8. The method of claim 1, wherein the proteases or catalytically active portions thereof in the complexes are displayed on a microorganism, and wherein following identification or selection of a protease or catalytically active portion thereof in the collection, the microorganism displaying the protease or catalytically active portion is grown to thereby amplify the nucleic acid molecules that encode the identified or selected protease or catalytically active portion thereof to produce a second collection of proteases and/or catalytically active portions thereof.

9. The method of claim 1, wherein the collection contains at least 5, 10, 50, 100, 500, $10^3$, $10^4$, $10^5$, $10^6$ or more different members.

10. The method of claim 1, where the proteases or catalytically active portions thereof are serine and/or cysteine proteases.

11. The method of claim 1, wherein the proteases or catalytically active portions thereof are displayed on a microorganism.

12. The method of claim 11, wherein the proteases or catalytically active portions thereof are displayed in a phage display library.

13. The method of claim 1, wherein the protease or catalytically active portions thereof are displayed on a solid support, on a cell surface, or on the surface of a microorganism.

14. The method of claim 1, wherein the proteases or catalytically active portions thereof are displayed on the surface of a yeast, bacterium, a virus, a phage, a nucleic acid, an mRNA molecule or on ribosomes.

15. The method of claim 1, wherein the proteases are provided as catalytically active portions of a protease.

16. The method of claim 1, wherein:
   at least two different protease trap polypeptides are contacted with the collection; and
   at least one of the protease trap polypeptides is detectably labeled to effect capture of stable complexes containing the detectable protease trap polypeptide and a protease or catalytically active portion thereof.

17. The method of claim 16, wherein:
   only one protease trap polypeptide is detectably labeled; and
   the other or others are each present in excesses compared to the detectably labeled protease trap polypeptide.

18. The method of claim 16, wherein the detectable label is a fluorescent label or a His tag.

19. The method of claim 16, wherein the detectable label is biotin.

20. The method of claim 1, wherein the proteases or catalytically active portions thereof are selected from the chymotrypsin, subtilisin, caspases or the papain family of proteases.

21. The method of claim 1, wherein:
   the protease is a serine protease, cysteine protease, or catalytically active portion thereof; and
   the protease or catalytically active portion thereof is selected from granzyme B, testisin, trypstase beta 1, kallikrein hk5, corin, kallikrein 12, DESC1 oritesase, trypstase gamma 1, kallikrein hK14, hyaluronan-binding serine protease, tryptase, kallikrein hK15, trypsin, neutrophil elastase, mannan-binding lectin-associated serine protease-3, cathepsin G, myeloblastin, granzyme A, granzyme M, chymase, granzyme K, granzyme H, chymotrypsin B, pancreatic elastase, pancreatic endopeptidase E, pancreatic elastaste II, enteropeptidase, chymotrypsin C, prostasin, kallikrein 1, kallikrein hK2, kallikrein 3, mesotrypsin, Factor XII, plasma kallikrein KLK3, factor XI, factor IX, factor VII, factor Xa, thrombin, protein C, acrosin, hepsin, hepatocyte growth factor activator, urinary plasminogen activator (uPA), tissue plasminogen activator (tPA), plasmin, neurosin, neurotrypsin, neuropsin, kallikrein hK10, epitheliasin, prostase, chymopasin, kallikrein 11, membrane type 1 matrix metalloprotease (MT-SP1), spinesin, cathepsin L, cathepsin V, cathepsin K, cathepsin S, cathepsin F, cathepsin B, papain, cruzain, subtilisin, thermitase, C5a peptidase, fervidolysin, lactocepin, furin, kexin, caspase-1, caspase-3, caspase-7, caspase-6, caspase-2, caspase-4, caspase-5, caspase-8, caspase-9, caspase-10, caspase-11, caspase-12, caspase-1, caspase-13, or caspase-14.

22. The method of claim 21, wherein the proteases or catalytically active portion thereof are selected from urokinase plasminogen activator (u-PA), tissue plasminogen activator (t-PA) or membrane type 1 matrix metalloprotease (MT-SP1).

23. The method of claim 21, wherein the protease trap polypeptide is a serpin or a p35 family member that comprises a cleavage sequence from the target protein substrate.

24. The method of claim 1, wherein the protease trap polypeptide is alpha2- macroglobulin, or a modified form thereof, wherein the modified form contains one or more amino acid replacements, in the reactive site in the protease trap polypeptide to include a cleavage sequence of the protein target substrate.

25. The method of claim 1, wherein the target substrate is a protein involved in the etiology of a disease or disorder.

26. The method of claim 1, wherein the target substrate is a vascular endothelial growth factor receptor (VEGFR), a complement protein, or a substrate of tissue plasminogen activator (tPA).

27. The method of claim 26, wherein the VEGFR is VEGFR2.

28. The method of claim 26, wherein the complement protein is C2.

29. The method of claim 1, wherein the protease trap polypeptide is modified in the reactive site by one or more amino acid replacements corresponding to a cleavage sequence that has a sequence of amino acids set forth in any of SEQ ID NOS: 389, 479 and 498.

30. The method of claim 1, wherein the protease trap polypeptide is alpha 2 macroglobulin, and the one or more amino acid replacements are in the bait region of the polypeptide.

31. The method of claim 1, wherein the method of identifying proteases is performed a plurality of times, whereby the process is iterative.

32. The method of claim 31, wherein the method is performed until a mutant protease is identified that exhibits increased substrate specificity and/or activity for a cleavage sequence in a target substrate compared to a non-target substrate that is a substrate of the corresponding protease not containing the mutation(s).

33. The method of claim 31, wherein a plurality of different proteases are identified at least in the first iteration of the method.

34. The method of claim 31, further comprising comparing the amino acid sequences of the identified proteases to identify hot spots, wherein:
a hot spot is a modified locus that occurs in at least two, three, four, five or more of the identified mutant proteases compared to the protease not containing the mutation(s).

35. The method of claim 1, further comprising:
after identifying a first protease or proteases, preparing a second collection of proteases, wherein an identified first protease is used as a template to make further mutations in the protease sequence or catalytically active portion thereof such that members of the second collection contain polypeptides having mutations of the identified first proteases and additional mutations;
then contacting the second collection with a second protease trap polypeptide that is either identical or different from the first protease trap polypeptide used to isolate the first protease or proteases, wherein:
the second protease trap polypeptides is a serpin, alpha macroglobulin, p35 family protein or a modified form thereof that comprises in the reactive site amino acid residues containing a cleavage sequence of the protein target substrate; and
upon cleavage of the amino acid residues in the second protease trap polypeptide by a protease or catalytically active portion thereof in the collection, covalent complexes of the protease trap polypeptide with the protease or catalytically active portion thereof in the collection are produced; and
identifying a second protease(s) or catalytically active portion(s) thereof from the collection in the complex, whereby the second identified protease(s) has greater activity or specificity towards the target substrate than the first identified protease.

36. The method of claim 1, wherein in step a) the method further comprises adding a competitor to the reaction between a protease trap polypeptide and a protease or catalytically active portion thereof to thereby enhance selectivity of identified protease(s) or catalytically active portion(s).

37. The method of claim 36, wherein the competitor is human serum or plasma.

38. The method of claim 36, wherein the competitor is a cell or tissue extract or a biological fluid.

39. The method of claim 36, wherein the competitor is a wild-type form of a protease trap polypeptide or a variant of a protease trap polypeptide.

40. The method of claim 1, further comprising screening proteases or catalytically active portions thereof that formed complexes to assess the substrate specificity of these proteases or catalytically active portions thereof for the cleavage sequence of the target substrate compared to a non-target substrate.

41. The method of claim 1, wherein the protease is human kallikrein 8.

42. The method of claim 1, wherein the collection contains 2 different members.

43. The method of claim 1, wherein the target substrate is selected from Interleukin-5 (IL-5), IL-5 receptor, IL-1, IL-1 receptor, IL-13, IL-13receptor, IL-12, IL-12 receptor, IL-4, IL-4 receptor, tumor necrosis factor (TNF), TNF receptor, C-C chemokine receptor type 5 (CCR5), CXC chemokine receptor 4 (CXCR4), gp120, gp141, CD4, RSV fusion protein, hemagglutinin, B7, CD28, IgE; IgE receptor, CD2, CD3, CD40, IL-2, IL-2 receptor, vascular endothelial growth factor (VEGF), fibroblast growth factor (FGF), epidermal growth factor (EGF), transforming growth factor (TGF), HER2, C-C chemokine receptor type 1 (CCR1), CXC chemokine receptor 3 (CXCR3), C-C chemokine receptor type 3(CCR3), Src, Akt, Bcl-2, BCR-Abl, GSK-3, Cdk-2, Cdk-4, EGFR, VEGFR-1, VEGFR-2 or a complement protein.

44. The method of claim 1, wherein the protease trap polypeptide is modified in the reactive site by one or more amino acid replacements corresponding to a cleavage sequence that has a sequence of amino acids set forth in any of SEQ ID NOS: 406-432 and 480-489.

45. The method of claim 1, wherein the protease is a serine protease, cysteine protease, or catalytically active portion thereof.

46. A method for identifying or selecting a protease or catalytically active portion thereof that cleaves a cleavage sequence in a protein target substrate, comprising:
   a) contacting a collection of a plurality of different mutant proteases and/or catalytically active portions thereof that comprise the mutations(s) with a protease trap polypeptide, wherein:
   the protease trap polypeptide is a serpin selected from plasminogen activator inhibitor-1 (PAI-1), antithrombin III (AT3), and modified forms thereof, wherein the modified form contains one or more amino acid replacements, deletions, or substitutions in the reactive site in the protease trap polypeptide to include a cleavage sequence of the protein target substrate;
   the protease trap polypeptide comprises a cleavage sequence for the protein target substrate;
   upon cleavage of amino acids in the cleavage sequence included in the reactive site in the protease trap polypeptide by a protease or catalytically active portion thereof in the collection, the protease trap polypeptide forms a covalent bond with a protease or catalytically active portion thereof in the collection to form a stable complex containing the protease or catalytically active portion thereof with a protease trap polypeptide;
   b) separating the complexed proteases from uncomplexed members of the collection; and
   c) identifying or selecting the protease or catalytically active portion thereof in the complex, thereby identifying or selecting a protease or catalytically active portion thereof that cleaves the protein target substrate.

47. The method of claim 46, wherein the protease is a serine protease, cysteine protease, or catalytically active portion thereof.

48. A method for identifying or selecting a protease or catalytically active portion thereof that cleaves a cleavage sequence in a protein target substrate, comprising:
   a) contacting a collection of a plurality of different mutant proteases and/or catalytically active portions thereof that comprise the mutations(s) with a protease trap polypeptide, wherein:
   the protease trap polypeptide is a modified serpin and the one or more amino acid replacements is/are in the reactive site loop of the serpin polypeptide;
   the protease trap polypeptide comprises a cleavage sequence for the protein target substrate;
   upon cleavage of amino acids in the cleavage sequence included in the reactive site in the protease trap polypeptide by a protease or catalytically active portion thereof in the collection, the protease trap polypeptide forms a covalent bond with a protease or catalytically active portion thereof in the collection to form a stable complex containing the protease or catalytically active portion thereof with a protease trap polypeptide;
   b) separating the complexed proteases from uncomplexed members of the collection; and
   c) identifying or selecting the protease or catalytically active portion thereof in the complex, thereby identifying or selecting a protease or catalytically active portion thereof that cleaves the protein target substrate.

49. The method of claim 48, wherein the one or more amino acid replacements are in any one or more of the P4-P2' positions.

50. The method of claim 49, wherein the serpin has a sequence of amino acids set forth in any of SEQ ID NOS: 497, 499, 610 and 611.

51. An iterative method for selecting or identifying a mutant protease or catalytically active portion thereof with specificity/selectivity and/or activity for at least two different cleavage sequences in a protein target substrate, comprising:
   a) contacting a collection comprising a plurality of mutant proteases and/or catalytically active portions thereof that comprise the mutation(s) with a first protease trap polypeptide, wherein:
   the first protease trap polypeptide comprises a first cleavage sequence;
   contacting is effected in the presence of a competitor to thereby enhance selectivity of identified protease(s) or catalytically active portion(s); and
   upon cleavage of amino acids in the cleavage sequence in the protease trap polypeptide by the protease or catalytically active portion thereof, the protease trap polypeptide forms a covalent bond with the protease to form stable complexes containing the first protease trap polypeptide with a protease or catalytically active portion thereof in the collection;
   b) separating the complexed proteases from uncomplexed members of the collection; and
   c) identifying or selecting the proteases or catalytically active portions thereof that form complexes with the first protease trap polypeptide;
   d) contacting the identified or selected proteases or catalytically active portion thereof with a second protease trap polypeptide in the presence of a competitor, wherein: the second protease trap polypeptide comprises a second cleavage sequence; and
   e) identifying or selecting the proteases or catalytically active portions thereof that form complexes with the second protease trap polypeptide,
   whereby the identified or selected protease or catalytically active portion thereof has substrate specificity and/or cleavage activity for at least two cleavage sequences, wherein:
   the first and second protease trap polypeptides are the same or different;
   each of the protease trap polypeptides is a serpin, alpha macroglobulin, p35 family protein or a modified form thereof that comprises in the reactive site amino acid residues containing a cleavage sequence of a protein target substrate; and
   upon cleavage of the amino acid residues in the protease trap polypeptide by a protease or catalytically active portion thereof in the collection, covalent complexes of the protease trap polypeptide with the protease or catalytically active portion thereof in the collection are produced.

52. The method of claim 51, wherein the at least two cleavage sequences are in one target substrate.

53. The method of claim 51, wherein the at least two cleavage sequences are in two different target substrates.

54. The method of claim 51, wherein the first and second protease trap polypeptide are different and each is modified in the reactive site of the protease trap polypeptide by one or more amino acid replacements containing a cleavage sequence of a different target substrate.

55. The method of claim 51, further comprising repeating steps a)- c) or a)- e) at least once more until an identified or selected protease with a predetermined substrate specificity and/or cleavage activity to at least two cleavage sequences is isolated.

56. The method of claim 51, wherein the first and second protease trap polypeptides are selected from a serpin, a p35 family member, an alpha-macroglobulin family member, a modified serpin, a modified alpha macroglobulin family member, or a modified p35 family member, wherein the modified form thereof is modified in the reactive site by one or more amino acid replacements, deletions or substitutions to include amino acids of the cleavage sequence of the protein target substrate.

57. A method of selecting a protease, comprising:
  a) contacting a collection comprising a plurality of different mutant proteases or catalytically active portions thereof that comprise the mutation(s) with a first protease trap polypeptide, wherein:
    the first protease trap polypeptide is a serpin, alpha macroglobulin, p35 family protein or a modified form thereof that comprises in the reactive site amino acid residues containing a cleavage sequence in a protein target substrate; and
    upon cleavage of the amino acid residues in the protease trap polypeptide by a protease or catalytically active portion thereof in the collection, covalent complexes of the protease trap polypeptide with the protease or catalytically active portion thereof in the collection are produced;
  b) separating the complexed proteases from uncomplexed proteases;
  c) isolating or selecting or identifying the proteases in the complex;
  d) generating a second collection of proteases or catalytically active portions of proteases based on the selected proteases;
  e) repeating steps a) - c) by contacting the second collection of proteases or catalytically active portions thereof with a second protease trap polypeptide, wherein:
    the second protease trap polypeptide is a serpin, alpha macroglobulin, p35 family protein or a modified form thereof that comprises in the reactive site amino acid residues containing a cleavage sequence of a protein target substrate, but is different from the first protease trap polypeptide to form complexes with proteases or catalytically active portions of proteases;
  f) separating the complexed proteases from uncomplexed proteases; and
  g) isolating, selecting or identifying the proteases in the complex.

58. The method of claim 57, wherein the first and second protease trap polypeptides are modified to contain two different target substrate cleavage sequences, whereby the identified or selected protease has specificity and high cleavage activity to at least two cleavage sequences.

59. The method of claim 57, wherein the first and second protease trap polypeptides are selected from a serpin, a p35 family member, an alpha-macroglobulin family member, a modified serpin, a modified alpha macroglobulin family member, or a modified p35 family member, wherein the modified form thereof is modified in the reactive site by one or more amino acid replacements, deletions or substitutions to include amino acids of the cleavage sequence of the protein target substrate.

* * * * *

UNITED STATES PATENT AND TRADEMARK OFFICE
CERTIFICATE OF CORRECTION

PATENT NO. : 8,211,428 B2
APPLICATION NO. : 11/825627
DATED : July 3, 2012
INVENTOR(S) : Edwin L. Madison Page 1 of 4

It is certified that error appears in the above-identified patent and that said Letters Patent is hereby corrected as shown below:

IN THE TITLE PAGES:

In Item (56) References Cited, in the list of OTHER PUBLICATIONS at page 6, column I, line 59, replace "Growl" with --Crowl--;

In Item (56) References Cited, in the list of OTHER PUBLICATIONS at page 6, column II, line 69, replace "Render" with --Rinder--;

In Item (56) References Cited, in the list of OTHER PUBLICATIONS at page 9, column I, line 5, replace "248810" with --Z48810--;

In Item (56) References Cited, in the list of OTHER PUBLICATIONS at page 9, column I, line 32, replace "NIVI_000931" with --NM_000931--; and In Item (56) References Cited, add to the list of OTHER PUBLICATIONS --Translation of Chinese Office Action, issued December 15, 2010, in connection with Chinese Patent Application No. 200780032858.4--.

IN THE SPECIFICATION:

At column 9, line 11, replace "F301" with --F30I--;

at column 13, line 40, replace "RRVARM" with --RRARM--;

at column 37, line 45, replace "1. Serpins Structure, Function, and Expression" with --1. Serpins: Structure, Function, and Expression--;

at column 49, line 17, replace "SEQ ID NO: 6" with --SEQ ID NO: 639--;

Signed and Sealed this
Twenty-fifth Day of June, 2013

Teresa Stanek Rea
*Acting Director of the United States Patent and Trademark Office*

CERTIFICATE OF CORRECTION (continued)
U.S. Pat. No. 8,211,428 B2 at column 152, lines 64-65, replace
"GTCACTGACTGACGTGGATCCCACGGGAGCCCTGTGGACATC" with
--GTCACTGACTGACGT*GGATCCC*ACGGGAGCCCTGTGGACATC--;

at column 155, line 9, replace "Clonig" with --Cloning--;

at column 156, lines 12-13, replace
"GCGCAGATATCGTACCGCATATGAAAAAGAATATCGCATTCTT" with
--GCGCAGATATCGTACCGCATATG*AAAAAGAATATCGCATTCTT*--;

at column 156, lines 18-19, replace
"GTGCATGCTGACTGACTGAGCTCCCGCTTACCCCAGTGTTCTC" with
--GTGCATGCTGACTGACTGAGCT*CCCGCTTACCCCAGTGTTCTC*--;

at column 169, lines 60-61, replace
"TTCACGAGACAGGCTCGTGTTGTTGGGGGCACGGAT" with
--TTCACGAGACAGGCTCGTGTTGTTGGGGGCACGGAT--;

at column 169, line 63, replace
"CAGCTAATTAAGCTTATTATACCCCAGTGTTCTCTTT" with
-- CAGCTAATTAAGCTTATTATACCCCAGTGTTCTCTTT --;

at column 169, line 67 to column 170, line 1, replace
"ACGAGCCTGTCTCGTGAATGACCGCAGCCC" with
--ACGAGCCTGTCTCGTGAATGACCGCAGCCC--; and at column 170, line 3, replace
"TAATAAGCTTAATTAGCTGAGCTTGGACTCC" with
--TAATAAGCTTAATTAGCTGAGCTTGGACTCC--.

IN THE CLAIMS:

Column 175, line 2 to line 37 should read --
1. A method for identifying or selecting a protease or catalytically active portion thereof that cleaves a cleavage sequence in a protein target substrate, comprising:
a) contacting a collection comprising a plurality of different mutant proteases and/or catalytically active portions thereof that comprise the mutations(s) with a protease trap polypeptide, wherein:
the protease trap polypeptide is a serpin or modified serpin, an alpha macroglobulin or a modified member of the alpha macroglobulin family, or, a p35 protein or a modified member of the p35 family;
the protease trap polypeptide comprises a reactive site containing a cleavage sequence for the protein target substrate, or is modified in its reactive site by replacement of one or more of amino acids in the P4-P2' positions of the protease trap polypeptide to include the cleavage sequence of the protein target substrate;
contacting is effected under conditions for cleavage of amino acids in the cleavage sequence in the protease trap polypeptide by a protease or a catalytically active portion thereof in the collection to form stable complexes containing the protease trap polypeptide covalently linked to a protease or catalytically active portion thereof;

CERTIFICATE OF CORRECTION (continued)
U.S. Pat. No. 8,211,428 B2 upon cleavage of amino acids in the cleavage sequence in the protease trap polypeptide by a protease or catalytically active portion thereof in the collection, the protease trap polypeptide forms a stable complex with a protease or catalytically active portion thereof in the collection;

b) separating the complexed proteases from uncomplexed members of the collection; and c) identifying or selecting the protease or catalytically active portion thereof in the complex, thereby identifying or selecting a protease or catalytically active portion thereof that cleaves the protein target substrate.

Column 176, line 11 to line 13 should read --

10. The method of claim 1, wherein the proteases or catalytically active portions thereof are serine and/or cysteine proteases.

Column 176, line 45 to line 47 should read --

20. The method of claim 1, wherein the proteases or catalytically active portions thereof are selected from the chymotrypsin, subtilisin, caspase or the papain family of proteases.

Column 176, line 48 to column 177, line 9 should read --

21. The method of claim 1, wherein:
the protease is a serine protease, cysteine protease, or catalytically active portion thereof; and
the protease or catalytically active portion thereof is selected from granzyme B, testisin, trypstase beta 1, kallikrein hK5, corin, kallikrein 12, DESC1 oritesase, trypstase gamma 1, kallikrein hK14, hyaluronan-binding serine protease, tryptase, kallikrein hK15, trypsin, neutrophil elastase, mannan-binding lectin-associated serine protease-3, cathepsin G, myeloblastin, granzyme A, granzyme M, chymase, granzyme K, granzyme H, chymotrypsin B, pancreatic elastase, pancreatic endopeptidase E, pancreatic elastaste II, enteropeptidase, chymotrypsin C, prostasin, kallikrein 1, kallikrein hK2, kallikrein 3, mesotrypsin, Factor XII, plasma kallikrein KLK3, factor XI, factor IX, factor VII, factor Xa, thrombin, protein C, acrosin, hepsin, hepatocyte growth factor activator, urinary plasminogen activator (uPA), tissue plasminogen activator (tPA), plasmin, neurosin, neurotrypsin, neuropsin, kallikrein hK10, epitheliasin, prostase, chymopasin, kallikrein 11, membrane type 1 serine protease (MT-SP1), spinesin, cathepsin L, cathepsin V, cathepsin K, cathepsin S, cathepsin F, cathepsin B, papain, cruzain, subtilisin, thermitase, C5a peptidase, fervidolysin, lactocepin, furin, kexin, caspase-1, caspase-3, caspase-7, caspase-6, caspase-2, caspase-4, caspase-5, caspase-8, caspase-9, caspase-10, caspase-11, caspase-12, caspase-13, or caspase-14.

Column 177, line 10 to line 14 should read --

22. The method of claim 21, wherein the proteases or catalytically active portion thereof are selected from urokinase plasminogen activator (u-PA), tissue plasminogen activator (t-PA) or membrane type 1 serine protease (MT-SP1).

CERTIFICATE OF CORRECTION (continued)
U.S. Pat. No. 8,211,428 B2

Column 177, line 18 to line 23 should read --

24. The method of claim 1, wherein the protease trap polypeptide is alpha 2-macroglobulin, or a modified form thereof, wherein the modified form contains one or more amino acid replacements in the reactive site in the protease trap polypeptide to include a cleavage sequence of the protein target substrate.

Column 177, line 62 to column 178, line 23 should read --

35. The method of claim 1, further comprising:
after identifying a first protease or proteases, preparing a second collection of proteases, wherein an identified first protease is used as a template to make further mutations in the protease sequence or catalytically active portion thereof such that members of the second collection contain polypeptides having mutations of the identified first proteases and additional mutations;
then contacting the second collection with a second protease trap polypeptide that is either identical or different from the first protease trap polypeptide used to isolate the first protease or proteases, wherein:
the second protease trap polypeptide is a serpin alpha macroglobulin, p35 family protein or a modified form thereof that comprises in the reactive site amino acid residues containing a cleavage sequence of the protein target substrate; and
upon cleavage of the amino acid residues in the second protease trap polypeptide by a protease or catalytically active portion thereof in the collection, covalent complexes of the protease trap polypeptide with the protease or catalytically active portion thereof in the collection are produced; and
identifying a second protease(s) or catalytically active portion(s) thereof from the collection in the complex, whereby the second identified protease(s) has greater activity or specificity towards the target substrate than the first identified protease.

Column 178, line 46 to line 59 should read --

43. The method of claim 1, wherein the target substrate is selected from Interleukin-5 (IL-5), IL-5 receptor, IL-1, IL-1 receptor, IL-13, IL-13 receptor, IL-12, IL-12 receptor, IL-4, IL-4 receptor, tumor necrosis factor (TNF), TNF receptor, (C-C chemokine receptor type 5 (CCR5), CXC chemokine receptor 4 (CXCR4), gp120, gp141, CD4, RSV fusion protein, hemagglutinin, B7, CD28, IgE, IgE receptor, CD2, CD3, CD40, IL-2, IL-2 receptor, vascular endothelial growth factor (VEGF), fibroblast growth factor (FGF), epidermal growth factor (EGF), transforming growth factor (TGF), HER2, C-C chemokine receptor type 1 (CCR1), CXC chemokine receptor 3 (CXCR3), C-C chemokine receptor type 3 (CCR3), Src, Akt, Bcl-2, BCR-Abl, GSK-3, Cdk-2, Cdk-4, EGFR, VEGFR-1, VEGFR-2 or a complement protein.